US012442002B2

(12) United States Patent
Ngai et al.

(10) Patent No.: US 12,442,002 B2
(45) Date of Patent: Oct. 14, 2025

(54) RNAi AGENTS FOR INHIBITING EXPRESSION OF ACTIVIN RECEPTOR-LIKE KINASE 7 (ALK7), COMPOSITIONS THEREOF, AND METHODS OF USE

(71) Applicant: Arrowhead Pharmaceuticals, Inc., Pasadena, CA (US)

(72) Inventors: Michelle Ngai, Fitchburg, WI (US); Mark Majewski, Rockton, IL (US); Zhi-Ming Ding, Waunakee, WI (US); Agnieszka Glebocka, Madison, WI (US); Tao Pei, Middleton, WI (US); James C. Hamilton, Sierra Madre, CA (US); Grigoriy Shekhtman, Los Angeles, CA (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 0 days.

(21) Appl. No.: 18/988,719

(22) Filed: Dec. 19, 2024

(65) Prior Publication Data

US 2025/0207139 A1 Jun. 26, 2025

Related U.S. Application Data

(60) Provisional application No. 63/683,214, filed on Aug. 14, 2024, provisional application No. 63/634,860, filed on Apr. 16, 2024, provisional application No. 63/612,531, filed on Dec. 20, 2023.

(51) Int. Cl.
*C12N 15/113* (2010.01)

(52) U.S. Cl.
CPC .... *C12N 15/1137* (2013.01); *C12Y 207/1103* (2013.01); *C12N 2310/14* (2013.01); *C12N 2310/312* (2013.01); *C12N 2310/321* (2013.01); *C12N 2310/322* (2013.01); *C12N 2320/35* (2013.01)

(58) Field of Classification Search
CPC ............ C12N 15/1137; C12N 2310/14; C12N 2310/312; C12N 2310/321; C12N 2310/322; C12N 2320/35; C12Y 207/1103
See application file for complete search history.

(56) References Cited

U.S. PATENT DOCUMENTS

| | | | | |
|---|---|---|---|---|
| 4,522,811 | A | 6/1985 | Eppstein et al. | |
| 5,998,203 | A | 12/1999 | Matulic-adamic et al. | |
| 2005/0244851 | A1 | 11/2005 | Blume et al. | |
| 2008/0113351 | A1 | 5/2008 | Naito et al. | |
| 2012/0322851 | A1* | 12/2012 | Hardee | A61K 9/0053 514/44 R |
| 2022/0119491 | A1* | 4/2022 | Kumar | A61P 9/10 |

FOREIGN PATENT DOCUMENTS

| | | | |
|---|---|---|---|
| WO | 2000053722 | A2 | 9/2000 |
| WO | 2006006948 | A2 | 1/2006 |
| WO | 2008022309 | A2 | 2/2008 |
| WO | 2009099991 | A1 | 2/2009 |
| WO | 2011104169 | A1 | 9/2011 |
| WO | 2012083185 | A2 | 6/2012 |
| WO | 2013032829 | A1 | 3/2013 |
| WO | 2013158141 | A1 | 10/2013 |
| WO | 2017214112 | A1 | 12/2017 |
| WO | 2018044350 | A1 | 3/2018 |
| WO | 2019161213 | A1 | 8/2019 |
| WO | 2023003922 | A1 | 1/2023 |
| WO | 2025064660 | A1 | 3/2025 |

OTHER PUBLICATIONS

Mizrahy, Shoshy, et al. "Current progress in non-viral RNAi-based delivery strategies to lymphocytes." Molecular Therapy 25.7 (2017): 1491-1500 . . . (Year: 2017).*
Morrissey, David V., et al. "Activity of stabilized short interfering RNA in a mouse model of hepatitis B virus replication." Hepatology 41.6 (2005): 1349-1356 . . . (Year: 2005).*
Fakhr, E., Zare, F. & Teimoori-Toolabi, L. Cancer Gene Ther 23, 73-82 (2016) (Year: 2016).*
Aartsma-Rus, Annemieke, et al. Molecular Therapy 17.3 (2009): 548-553. (Year: 2009).*
GenBank1, *Homo sapiens* truncated activin receptor-like kinase 7 (ALK7) mRNA, complete cds; alternatively spliced, AF525679.1, https://www.ncbi.nlm.nih.gov/nuccore/30146569?sat=4&satkey=39401918, Revision Apr. 28, 2003, retrieved Mar. 18, 2024, printed as pp. 1/2 to 2/2 (Year: 2003).*
Altenhofer EF, Lawler MJ, Kumar P, Joyce LA, Fowler-Watters M, Pei T, Li Z. Synthesis of a novel cyclopropyl phosphonate nucleotide as a phosphate mimic. Chem Commun (Camb). Jul. 14, 2021;57(55):6808-6811. doi: 10.1039/d1cc02328d. Epub Jun. 18, 2021. PMID: 34142689.
Cheng WL, Zhang Q, Cao JL, Chen XL, Li W, Zhang L, Chao SP, Zhao F. ALK7 Acts as a Positive Regulator of Macrophage Activation through Down-Regulation of PPARγ Expression. J Atheroscler Thromb. Apr. 1, 2021;28 (4):375-384. doi: 10.5551/jat.54445. Epub Jul. 9, 2020. PMID: 32641645; PMCID: PMC8147563.

(Continued)

*Primary Examiner* — Ekaterina Poliakova-Georgantas
*Assistant Examiner* — John Charles Mckillop
(74) *Attorney, Agent, or Firm* — Paul VanderVelde; Meibo Chen; Mitchell Porter

(57) ABSTRACT

Described are RNAi agents, compositions that include RNAi agents, and methods for inhibition of an Activin Receptor-Like Kinase 7 (ALK7) gene. The ALK7 RNAi agents and RNAi agent conjugates disclosed herein inhibit the expression of an ALK7 gene. Pharmaceutical compositions that include one or more ALK7 RNAi agents, optionally with one or more additional therapeutics, are also described. Delivery of the described ALK7 RNAi agents to adipose tissue, in vivo, provides for inhibition of ALK7 gene expression and a reduction in ALK7 activity, which can provide a therapeutic benefit to subjects, including human subjects, for the treatment of various diseases including obesity, diabetes, or insulin resistance.

19 Claims, 43 Drawing Sheets

Specification includes a Sequence Listing.

(56) References Cited

OTHER PUBLICATIONS

Czauderna F, Fechtner M, Dames S, Aygün H, Klippel A, Pronk GJ, Giese K, Kaufmann J. Structural variations and stabilising modifications of synthetic siRNAs in mammalian cells. Nucleic Acids Res. Jun. 1, 2003;31(11):2705-16. doi: 10.1093/nar/gkg393. PMID: 12771196; PMCID: PMC156727.

Emdin CA, Khera AV, Aragam K, Haas M, Chaffin M, Klarin D, Natarajan P, Bick A, Zekavat SM, Nomura A, Ardissino D, Wilson JG, Schunkert H, McPherson R, Watkins H, Elosua R, Bown MJ, Samani NJ, Baber U, Erdmann J, Gupta N, Danesh J, Saleheen D, Gabriel S, Kathiresan S. DNA Sequence Variation in ACVR1C Encoding the Activin Receptor-Like Kinase 7 Influences Body Fat Distribution and Protects Against Type 2 Diabetes. Diabetes. Jan. 2019;68 (1):226-234. doi: 10.2337/db18-0857. Epub Nov. 2, 2018. PMID: 30389748; PMCID: PMC6302541.

Zhao M, Okunishi K, Bu Y, Kikuchi O, Wang H, Kitamura T, Izumi T. Targeting activin receptor-like kinase 7 ameliorates adiposity and associated metabolic disorders. JCI Insight. Feb. 22, 2023;8(4):e161229. doi: 10.1172/jci.insight.161229. PMID: 36626233; PMCID: PMC9977491.

GenBank NM_145259.3; "*Homo sapiens* activin A receptor type 1C (ACVR1C), transcript variant 1, mRNA"; 2025.

International Search Report and Written Opinion for corresponding International Application No. PCT/US2024/061179 with a mailing date of Apr. 8, 2025.

* cited by examiner

RNAi AGENTS FOR INHIBITING EXPRESSION OF ACTIVIN RECEPTOR-LIKE KINASE 7 (ALK7), COMPOSITIONS THEREOF, AND METHODS OF USE

CROSS REFERENCE TO RELATED APPLICATIONS

This application claims the benefit of priority to U.S. Provisional Patent Application Ser. No. 63/612,531, filed on Dec. 20, 2023, U.S. Provisional Patent Application Ser. No. 63/634,860, filed on Apr. 16, 2024, and U.S. Provisional Patent Application Ser. No. 63/683,214, filed on Aug. 14, 2024, the contents of each of which are incorporated herein by reference in their entirety.

FIELD OF THE INVENTION

The present disclosure relates to RNA interference (RNAi) agents, e.g., double stranded RNAi agents such as chemically modified small interfering RNAs (siRNAs), for inhibition of Activin Receptor-Like Kinase 7 ("ALK7") gene expression, compositions that include ALK7 RNAi agents, and methods of use thereof.

SEQUENCE LISTING

This application contains a Sequence Listing (in compliance with Standard ST26), which has been submitted in xml format and is hereby incorporated by reference in its entirety. The xml sequence listing file is named 30730-US1_SeqListing.xml, created Dec. 9, 2024, and is 3,508,372 bytes in size.

BACKGROUND

As a key type I receptor for TGF-β family members, activin receptor-like kinase 7 (ALK7), also referred to as Acvr1c, has emerged as the determinate receptor for nodal and activin, both of which are implicated in various diseases. ALK7 is specifically expressed during the late phase of adipocyte differentiation. Adipocyte specific ALK7 dysfunction causes increased lipolysis, which leads to decreased fat accumulation, while ALK7 is also associated with multiple factors implicated in metabolic disease. ALK7 decreases inflammatory adipocytokine secretion and improves glucose tolerance and insulin sensitivity, and also protects against the development of pathological cardiac hypertrophy. Cheng et al. ALK7 Acts as a Positive Regulator of Macrophage Activation through Down-Regulation of PPARγ Expression. J Atheroscler Thromb. 2021 Apr. 1; 28 (4): 375-384. doi: 10.5551/jat.54445. Epub 2020 Jul. 9. PMID: 32641645; PMCID: PMC8147563.

ALK7 is known to be predominantly expressed in adipose tissue compared with other tissues. Whole body ALK7-KO mice show reduced fat accumulation when under a high-fat diet. JCI Insight. 2023; 8 (4): e161229.https://doi.org/10.1172/jci.insight.161229.

SUMMARY

There exists a need for novel RNA interference (RNAi) agents (termed RNAi agents, RNAi triggers, or triggers), e.g., double stranded RNAi agents such as siRNAs, that are able to selectively and efficiently inhibit the expression of an ALK7 gene, including for use as a therapeutic or medicament. Further, there exists a need for compositions of novel ALK7-specific RNAi agents for the treatment of diseases or disorders associated with ALK7 gene expression and/or disorders that can be mediated at least in part by a reduction in ALK7 gene expression.

The nucleotide sequences and chemical modifications of the ALK7 RNAi agents disclosed herein, as well as their combination with certain specific pharmacokinetic and pharmacodynamic (PK/PD) modulators suitable for selectively and efficiently delivering the ALK7 RNAi agents to adipose tissue in vivo, differ from those previously disclosed or known in the art. The ALK7 RNAi agents disclosed herein provide for highly potent and efficient inhibition of the expression of an ALK7 gene.

In general, the present disclosure features ALK7 gene-specific RNAi agents, compositions that include ALK7 RNAi agents, and methods for inhibiting expression of an ALK7 gene in vitro and/or in vivo using the ALK7 RNAi agents and compositions that include ALK7 RNAi agents described herein. The ALK7 RNAi agents described herein are able to selectively and efficiently decrease expression of an ALK7 gene, and thereby reduce the expression of the ALK7 protein.

The described ALK7 RNAi agents can be used in methods for therapeutic treatment (including preventative or prophylactic treatment) of symptoms and diseases including, but not limited to obesity, diabetes, or insulin resistance.

In one aspect, the disclosure features RNAi agents for inhibiting expression of an ALK7 gene, wherein the RNAi agent includes a sense strand (also referred to as a passenger strand) and an antisense strand (also referred to as a guide strand). The sense strand and the antisense strand can be partially, substantially, or fully complementary to each other. The length of the RNAi agent sense strands described herein each can be 15 to 49 nucleotides in length. The length of the RNAi agent antisense strands described herein each can be 18 to 49 nucleotides in length. In some embodiments, the sense and antisense strands are independently 18 to 26 nucleotides in length. The sense and antisense strands can be either the same length or different lengths. In some embodiments, the sense and antisense strands are independently 21 to 26 nucleotides in length. In some embodiments, the sense and antisense strands are independently 21 to 24 nucleotides in length. In some embodiments, both the sense strand and the antisense strand are 21 nucleotides in length. In some embodiments, the antisense strands are independently 18, 19, 20, 21, 22, 23, 24, 25, 26, 27, 28, 29, or 30 nucleotides in length. In some embodiments, the sense strands are independently 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. The RNAi agents described herein, upon delivery to adipose tissue, inhibit the expression of one or more ALK7 gene variants in vivo and/or in vitro.

The ALK7 RNAi agents disclosed herein target a human ALK7 gene (see, e.g., SEQ ID NO: 1). In some embodiments, the ALK7 RNAi agents disclosed herein target a portion of an ALK7 gene having the sequence of any of the sequences disclosed in Table 1.

In another aspect, the disclosure features compositions, including pharmaceutical compositions, that include one or more of the disclosed ALK7 RNAi agents that are able to selectively and efficiently decrease expression of an ALK7 gene. The compositions that include one or more ALK7 RNAi agents described herein can be administered to a subject, such as a human or animal subject, for the treatment (including prophylactic treatment or inhibition) of symptoms and diseases associated with ALK7 protein levels.

Examples of ALK7 RNAi agent sense strands and antisense strands that can be used in an ALK7 RNAi agent are provided in Tables 3, 4, 5, and 6. Examples of ALK7 RNAi agent duplexes are provided in Tables 7A, 7B, 8, 9A, and 10. Examples of 19-nucleotide core stretch sequences that may consist of or may be included in the sense strands and antisense strands of certain ALK7 RNAi agents disclosed herein, are provided in Table 2.

In another aspect, the disclosure features methods for delivering ALK7 RNAi agents to adipose tissue in a subject, such as a mammal, in vivo. Also described herein are compositions for use in such methods. In some embodiments, disclosed herein are methods for delivering ALK7 RNAi agents to adipose tissue to a subject in vivo. In some embodiments, the subject is a human subject.

The methods disclosed herein include the administration of one or more ALK7 RNAi agents to a subject, e.g., a human or animal subject, by any suitable means known in the art. The pharmaceutical compositions disclosed herein that include one or more ALK7 RNAi agents can be administered in a number of ways depending upon whether local or systemic treatment is desired. Administration can be, but is not limited to, for example, intravenous, intraarterial, subcutaneous, intraperitoneal, subdermal (e.g., via an implanted device), and intraparenchymal administration. In some embodiments, the pharmaceutical compositions described herein are administered by subcutaneous or intravenous injection.

In some embodiments, it is desired that the ALK7 RNAi agents described herein inhibit the expression of an ALK7 gene in adipose tissue.

The one or more ALK7 RNAi agents can be delivered to target cells or tissues using any oligonucleotide delivery technology known in the art. In some embodiments, an ALK7 RNAi agent is delivered to cells or tissues by covalently linking the RNAi agent to a targeting group or a lipid moiety.

A PK/PD modulator can be linked to the 3' or 5' end of a sense strand or an antisense strand of an ALK7 RNAi agent. In some embodiments, a PK/PD modulator is linked to the 3' or 5' end of the sense strand. In some embodiments, a PK/PD modulator is linked to the 5' end of the sense strand. In some embodiments, a PK/PD modulator is linked internally to a nucleotide on the sense strand and/or the antisense strand of the RNAi agent. In some embodiments, a PK/PD modulator is linked to the RNAi agent via a linker.

In another aspect, the disclosure features compositions that include one or more ALK7 RNAi agents that have the duplex structures disclosed in Tables 7A, 7B, 8, 9A, and 10.

The use of ALK7 RNAi agents provides methods for therapeutic (including prophylactic) treatment of diseases or disorders for which a reduction in ALK7 protein levels can provide a therapeutic benefit. The ALK7 RNAi agents disclosed herein can be used to treat various metabolic diseases, including obesity, diabetes, or insulin resistance. Such methods of treatment include administration of an ALK7 RNAi agent to a human being or animal having elevated ALK7 protein beyond desirable levels.

Definitions

As used herein, the terms "oligonucleotide" and "polynucleotide" mean a polymer of linked nucleosides each of which can be independently modified or unmodified.

As used herein, an "RNAi agent" (also referred to as an "RNAi trigger") means a chemical composition of matter that contains an RNA or RNA-like (e.g., chemically modified RNA) oligonucleotide molecule that is capable of degrading or inhibiting (e.g., degrades or inhibits under appropriate conditions) translation of messenger RNA (mRNA) transcripts of a target mRNA in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. RNAi agents disclosed herein are comprised of a sense strand and an antisense strand, and include, but are not limited to: small (or short) interfering RNAs (siRNAs), double stranded RNAs (dsRNA), micro RNAs (miRNAs), short hairpin RNAs (shRNA), and dicer substrates. The antisense strand of the RNAi agents described herein is at least partially complementary to the mRNA being targeted (i.e. ALK7 mRNA). RNAi agents can include one or more modified nucleotides and/or one or more non-phosphodiester linkages.

As used herein, the terms "silence," "reduce," "inhibit," "down-regulate," or "knockdown" when referring to expression of a given gene, mean that the expression of the gene, as measured by the level of RNA transcribed from the gene or the level of polypeptide, protein, or protein subunit translated from the mRNA in a cell, group of cells, tissue, organ, or subject in which the gene is transcribed, is reduced when the cell, group of cells, tissue, organ, or subject is treated with the RNAi agents described herein as compared to a second cell, group of cells, tissue, organ, or subject that has not or have not been so treated.

As used herein, the terms "sequence" and "nucleotide sequence" mean a succession or order of nucleobases or nucleotides, described with a succession of letters using standard nomenclature.

As used herein, a "base," "nucleotide base," or "nucleobase," is a heterocyclic pyrimidine or purine compound that is a component of a nucleotide, and includes the primary purine bases adenine and guanine, and the primary pyrimidine bases cytosine, thymine, and uracil. A nucleobase may further be modified to include, without limitation, universal bases, hydrophobic bases, promiscuous bases, size-expanded bases, and fluorinated bases. (See, e.g., Modified Nucleosides in Biochemistry, Biotechnology and Medicine, Herdewijn, P. ed. Wiley-VCH, 2008). The synthesis of such modified nucleobases (including phosphoramidite compounds that include modified nucleobases) is known in the art.

As used herein, and unless otherwise indicated, the term "complementary," when used to describe a first nucleobase or nucleotide sequence (e.g., RNAi agent sense strand or targeted mRNA) in relation to a second nucleobase or nucleotide sequence (e.g., RNAi agent antisense strand or a single-stranded antisense oligonucleotide), means the ability of an oligonucleotide or polynucleotide including the first nucleotide sequence to hybridize (form base pair hydrogen bonds under mammalian physiological conditions (or otherwise suitable in vivo or in vitro conditions)) and form a duplex or double helical structure under certain standard conditions with an oligonucleotide that includes the second nucleotide sequence. The person of ordinary skill in the art would be able to select the set of conditions most appropriate for a hybridization test. Complementary sequences include Watson-Crick base pairs or non-Watson-Crick base pairs and include natural or modified nucleotides or nucleotide mimics, at least to the extent that the above hybridization requirements are fulfilled. Sequence identity or complementarity is independent of modification. For example, a and Af, as defined herein, are complementary to U (or T) and identical to A for the purposes of determining identity or complementarity.

As used herein, "perfectly complementary" or "fully complementary" means that in a hybridized pair of nucleobase or nucleotide sequence molecules, all (100%) of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "partially complementary" means that in a hybridized pair of nucleobase or nucleotide sequence molecules, at least 70%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "substantially complementary" means that in a hybridized pair of nucleobase or nucleotide sequence molecules, at least 85%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, the terms "complementary," "fully complementary," "partially complementary," and "substantially complementary" are used with respect to the nucleobase or nucleotide matching between the sense strand and the antisense strand of an RNAi agent, or between the antisense strand of an RNAi agent and a sequence of an ALK7 mRNA.

As used herein, the term "substantially identical" or "substantial identity," as applied to a nucleic acid sequence means the nucleotide sequence (or a portion of a nucleotide sequence) has at least about 85% sequence identity or more, e.g., at least 90%, at least 95%, or at least 99% identity, compared to a reference sequence. Percentage of sequence identity is determined by comparing two optimally aligned sequences over a comparison window. The percentage is calculated by determining the number of positions at which the same type of nucleic acid base occurs in both sequences to yield the number of matched positions, dividing the number of matched positions by the total number of positions in the window of comparison and multiplying the result by 100 to yield the percentage of sequence identity. The inventions disclosed herein encompass nucleotide sequences substantially identical to those disclosed herein.

As used herein, the terms "treat," "treatment," and the like, mean the methods or steps taken to provide relief from or alleviation of the number, severity, and/or frequency of one or more symptoms of a disease in a subject. As used herein, "treat" and "treatment" may include the prevention, management, prophylactic treatment, and/or inhibition or reduction of the number, severity, and/or frequency of one or more symptoms of a disease in a subject.

As used herein, the phrase "introducing into a cell," when referring to an RNAi agent, means functionally delivering the RNAi agent into a cell. The phrase "functional delivery," means delivering the RNAi agent to the cell in a manner that enables the RNAi agent to have the expected biological activity, e.g., sequence-specific inhibition of gene expression.

Unless stated otherwise, use of the symbol

as used herein means that any group or groups may be linked thereto that is in accordance with the scope of the inventions described herein.

As used herein, the term "isomers" refers to compounds that have identical molecular formulae, but that differ in the nature or the sequence of bonding of their atoms or in the arrangement of their atoms in space. Isomers that differ in the arrangement of their atoms in space are termed "stereoisomers." Stereoisomers that are not mirror images of one another are termed "diastereoisomers," and stereoisomers that are non-superimposable mirror images are termed "enantiomers," or sometimes optical isomers. A carbon atom bonded to four non-identical substituents is termed a "chiral center."

As used herein, unless specifically identified in a structure as having a particular conformation, for each structure in which asymmetric centers are present and thus give rise to enantiomers, diastereomers, or other stereoisomeric configurations, each structure disclosed herein is intended to represent all such possible isomers, including their optically pure and racemic forms. For example, the structures disclosed herein are intended to cover mixtures of diastereomers as well as single stereoisomers.

As used in a claim herein, the phrase "consisting of" excludes any element, step, or ingredient not specified in the claim. When used in a claim herein, the phrase "consisting essentially of" limits the scope of a claim to the specified materials or steps and those that do not materially affect the basic and novel characteristic(s) of the claimed invention.

The person of ordinary skill in the art would readily understand and appreciate that the compounds and compositions disclosed herein may have certain atoms (e.g., N, O, or S atoms) in a protonated or deprotonated state, depending upon the environment in which the compound or composition is placed. Accordingly, as used herein, the structures disclosed herein envisage that certain functional groups, such as, for example, OH, SH, or NH, may be protonated or deprotonated. The disclosure herein is intended to cover the disclosed compounds and compositions regardless of their state of protonation based on the environment (such as pH), as would be readily understood by the person of ordinary skill in the art. Correspondingly, compounds described herein with labile protons or basic atoms should also be understood to represent salt forms of the corresponding compound. Compounds described herein may be in a free acid, free base, or salt form. Pharmaceutically acceptable salts of the compounds described herein should be understood to be within the scope of the invention.

As used herein, the term "linked" or "conjugated" when referring to the connection between two compounds or molecules means that two compounds or molecules are joined by a covalent bond. Unless stated, the terms "linked" and "conjugated" as used herein may refer to the connection between a first compound and a second compound either with or without any intervening atoms or groups of atoms.

As used herein, the term "including" is used to herein mean, and is used interchangeably with, the phrase "including but not limited to." The term "or" is used herein to mean, and is used interchangeably with, the term "and/or," unless the context clearly indicates otherwise.

Unless otherwise defined, all technical and scientific terms used herein have the same meaning as commonly understood by one of ordinary skill in the art. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other objects, features, aspects, and advantages of the invention will be apparent from the following detailed description, accompanying figures, and from the claims.

DETAILED DESCRIPTION

RNAi Agents

Figure 1A:
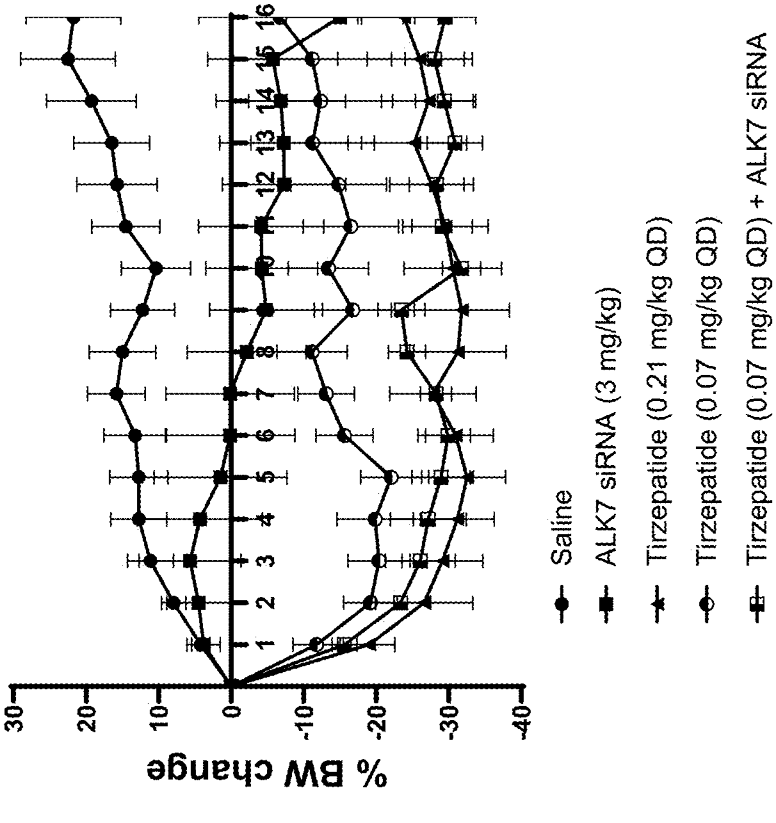
FIG. 1A shows the average body weights of mice administered a control formulation, RNAi agent, GLP1 agonist, or combination thereof according to Example 20.

Described herein are RNAi agents for inhibiting expression of the ALK7 (or Acvr1c) gene (referred to herein as ALK7 RNAi agents or ALK7 RNAi triggers). Each ALK7 RNAi agent disclosed herein comprises a sense strand and an antisense strand. The sense strand can be 15 to 49 nucleotides in length. The antisense strand can be 18 to 30 nucleotides in length. The sense and antisense strands can be either the same length or they can be different lengths. In some embodiments, the sense and antisense strands are each independently 18 to 27 nucleotides in length. In some embodiments, both the sense and antisense strands are each 21-26 nucleotides in length. In some embodiments, the sense and antisense strands are each 21-24 nucleotides in length. In some embodiments, the sense and antisense strands are each independently 19-21 nucleotides in length. In some embodiments, the sense strand is about 19 nucleotides in length while the antisense strand is about 21 nucleotides in length. In some embodiments, the sense strand is about 21 nucleotides in length while the antisense strand is about 23 nucleotides in length. In some embodiments, a sense strand is 23 nucleotides in length and an antisense strand is 21 nucleotides in length. In some embodiments, both the sense and antisense strands are each 21 nucleotides in length. In some embodiments, the RNAi agent sense strands are each independently 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. In some embodiments, the RNAi agent antisense strands are each independently 18, 19, 20, 21, 22, 23, 24, 25, 26, 27, 28, 29, or 30 nucleotides in length. In some embodiments, a double-stranded RNAi agent has a duplex length of about 16, 17, 18, 19, 20, 21, 22, 23 or 24 nucleotides.

Examples of nucleotide sequences used in forming ALK7 RNAi agents are provided in Tables 2, 3, 4, 5, 6, and 10. Examples of RNAi agent duplexes, that include the sense strand and antisense strand sequences in Tables 2, 3, 4, 5, 6, are shown in Tables 7A, 7B, 8, 9A, and 10.

In some embodiments, the region of perfect, substantial, or partial complementarity between the sense strand and the antisense strand is 16-26 (e.g., 16, 17, 18, 19, 20, 21, 22, 23, 24, 25, or 26) nucleotides in length and occurs at or near the 5' end of the antisense strand (e.g., this region may be separated from the 5' end of the antisense strand by 0, 1, 2, 3, or 4 nucleotides that are not perfectly, substantially, or partially complementary).

A sense strand of the ALK7 RNAi agents described herein includes at least 15 consecutive nucleotides that have at least 85% identity to a core stretch sequence (also referred to herein as a "core stretch" or "core sequence") of the same number of nucleotides in an ALK7 mRNA. In some embodiments, a sense strand core stretch sequence is 100% (perfectly) complementary or at least about 85% (substantially) complementary to a core stretch sequence in the antisense strand, and thus the sense strand core stretch sequence is typically perfectly identical or at least about 85% identical to a nucleotide sequence of the same length (sometimes referred to, e.g., as a target sequence) present in the ALK7 mRNA target. In some embodiments, this sense strand core stretch is 15, 16, 17, 18, 19, 20, 21, 22, or 23 nucleotides in length. In some embodiments, this sense strand core stretch is 17 nucleotides in length. In some embodiments, this sense strand core stretch is 19 nucleotides in length.

An antisense strand of an ALK7 RNAi agent described herein includes at least 16 consecutive nucleotides that have at least 85% complementarity to a core stretch of the same number of nucleotides in an ALK7 mRNA and to a core stretch of the same number of nucleotides in the corresponding sense strand. In some embodiments, an antisense strand core stretch is 100% (perfectly) complementary or at least about 85% (substantially) complementary to a nucleotide sequence (e.g., target sequence) of the same length present in the ALK7 mRNA target. In some embodiments, this antisense strand core stretch is 16, 17, 18, 19, 20, 21, 22, or 23 nucleotides in length. In some embodiments, this antisense strand core stretch is 19 nucleotides in length. In some embodiments, this antisense strand core stretch is 17 nucleotides in length. A sense strand core stretch sequence can be the same length as a corresponding antisense core sequence or it can be a different length.

The ALK7 RNAi agent sense and antisense strands anneal to form a duplex. A sense strand and an antisense strand of an ALK7 RNAi agent can be partially, substantially, or fully complementary to each other. Within the complementary duplex region, the sense strand core stretch sequence is at least 85% complementary or 100% complementary to the antisense core stretch sequence. In some embodiments, the sense strand core stretch sequence contains a sequence of at least 16, at least 17, at least 18, at least 19, at least 20, at least 21, at least 22, or at least 23 nucleotides that is at least 85% or 100% complementary to a corresponding 16, 17, 18, 19, 20, 21, 22, or 23 nucleotide sequence of the antisense strand core stretch sequence (i.e., the sense and antisense core stretch sequences of an ALK7 RNAi agent have a region of at least 16, at least 17, at least 18, at least 19, at least 20, at least 21, at least 22, or at least 23 nucleotides that is at least 85% base paired or 100% base paired.)

In some embodiments, the antisense strand of an ALK7 RNAi agent disclosed herein differs by 0, 1, 2, or 3 nucleotides from any of the antisense strand sequences in Table 2 or Table 3. In some embodiments, the sense strand of an ALK7 RNAi agent disclosed herein differs by 0, 1, 2, or 3 nucleotides from any of the sense strand sequences in Table 2, Table 4, Table 5, Table 6, Table 6a, or Table 10.

In some embodiments, the sense strand and/or the antisense strand can optionally and independently contain an additional 1, 2, 3, 4, 5, or 6 nucleotides (extension) at the 3' end, the 5' end, or both the 3' and 5' ends of the core stretch sequences. The antisense strand additional nucleotides, if present, may or may not be complementary to the corresponding sequence in the ALK7 mRNA. The sense strand additional nucleotides, if present, may or may not be identical to the corresponding sequence in the ALK7 mRNA. The antisense strand additional nucleotides, if present, may or may not be complementary to the corresponding sense strand's additional nucleotides, if present.

As used herein, an extension comprises 1, 2, 3, 4, 5, or 6 nucleotides at the 5' and/or 3' end of the sense strand core stretch sequence and/or antisense strand core stretch sequence. The extension nucleotides on a sense strand may or may not be complementary to nucleotides, either core stretch sequence nucleotides or extension nucleotides, in the corresponding antisense strand. Conversely, the extension nucleotides on an antisense strand may or may not be complementary to nucleotides, either core stretch nucleotides or extension nucleotides, in the corresponding sense strand. In some embodiments, both the sense strand and the antisense strand of an RNAi agent contain 3' and 5' extensions. In some embodiments, one or more of the 3' extension nucleotides of one strand base pairs with one or more 5' extension nucleotides of the other strand. In other embodiments, one or more of 3' extension nucleotides of one strand do not base pair with one or more 5' extension nucleotides of the other strand. In some embodiments, an ALK7 RNAi agent has an antisense strand having a 3' extension and a sense strand having a 5' extension. In some embodiments, the extension nucleotide(s) are unpaired and form an overhang. As used herein, an "overhang" refers to a stretch of one or more unpaired nucleotides located at a terminal end of either the sense strand or the antisense strand that does not form part of the hybridized or duplexed portion of an RNAi agent disclosed herein.

In some embodiments, an ALK7 RNAi agent comprises an antisense strand having a 3' extension of 1, 2, 3, 4, 5, or 6 nucleotides in length. In other embodiments, an ALK7 RNAi agent comprises an antisense strand having a 3' extension of 1, 2, or 3 nucleotides in length. In some embodiments, one or more of the antisense strand extension nucleotides comprise nucleotides that are complementary to the corresponding ALK7 mRNA sequence. In some embodiments, one or more of the antisense strand extension nucleotides comprise nucleotides that are not complementary to the corresponding ALK7 mRNA sequence.

In some embodiments, an ALK7 RNAi agent comprises a sense strand having a 3' extension of 1, 2, 3, 4, or 5 nucleotides in length. In some embodiments, one or more of the sense strand extension nucleotides comprises adenosine, uracil, or thymidine nucleotides, AT dinucleotide, or nucleotides that correspond to or are the identical to nucleotides in the ALK7 mRNA sequence. In some embodiments, the 3' sense strand extension includes or consists of one of the following sequences, but is not limited to: T, UT, TT, UU, UUT, TTT, or TTTT (each listed 5' to 3').

A sense strand can have a 3' extension and/or a 5' extension. In some embodiments, an ALK7 RNAi agent comprises a sense strand having a 5' extension of 1, 2, 3, 4, 5, or 6 nucleotides in length. In some embodiments, one or more of the sense strand extension nucleotides comprise nucleotides that correspond to or are identical to nucleotides in the ALK7 mRNA sequence.

Examples of sequences used in forming ALK7 RNAi agents are provided in Tables 2, 3, 4, 5, 6, and 10. In some embodiments, an ALK7 RNAi agent antisense strand includes a sequence of any of the sequences in Tables 2, 3, or 10. In certain embodiments, an ALK7 RNAi agent antisense strand comprises or consists of any one of the modified sequences in Table 3. In some embodiments, an ALK7 RNAi agent antisense strand includes the sequence of nucleotides (from 5' end→3' end) 1-17, 2-15, 2-17, 1-18, 2-18, 1-19, 2-19, 1-20, 2-20, 1-21, or 2-21, of any of the sequences in Tables 2 or 3. In some embodiments, an ALK7 RNAi agent sense strand includes the sequence of any of the sequences in Tables 2, 4, 5, or 6. In some embodiments, an ALK7 RNAi agent sense strand includes the sequence of nucleotides (from 5' end→3' end) 1-18, 1-19, 1-20, 1-21, 2-19, 2-20, 2-21, 3-20, 3-21, or 4-21 of any of the sequences in Tables 2, 4, 5, or 6. In certain embodiments, an ALK7 RNAi agent sense strand comprises or consists of a modified sequence of any one of the modified sequences in Table 4, 5, 6, or 10.

In some embodiments, the sense and antisense strands of the RNAi agents described herein contain the same number of nucleotides. In some embodiments, the sense and antisense strands of the RNAi agents described herein contain different numbers of nucleotides. In some embodiments, the sense strand 5' end and the antisense strand 3' end of an RNAi agent form a blunt end. In some embodiments, the sense strand 3' end and the antisense strand 5' end of an RNAi agent form a blunt end. In some embodiments, both ends of an RNAi agent form blunt ends. In some embodiments, neither end of an RNAi agent is blunt-ended. As used herein a "blunt end" refers to an end of a double stranded RNAi agent in which the terminal nucleotides of the two annealed strands are complementary (form a complementary base-pair).

In some embodiments, the sense strand 5' end and the antisense strand 3' end of an RNAi agent form a frayed end. In some embodiments, the sense strand 3' end and the antisense strand 5' end of an RNAi agent form a frayed end. In some embodiments, both ends of an RNAi agent form a frayed end. In some embodiments, neither end of an RNAi agent is a frayed end. As used herein a frayed end refers to an end of a double stranded RNAi agent in which the terminal nucleotides of the two annealed strands form a pair (i.e., do not form an overhang) but are not complementary (i.e. form a non-complementary pair). In some embodiments, one or more unpaired nucleotides at the end of one strand of a double stranded RNAi agent form an overhang. The unpaired nucleotides may be on the sense strand or the antisense strand, creating either 3' or 5' overhangs. In some embodiments, the RNAi agent contains: a blunt end and a frayed end, a blunt end and 5' overhang end, a blunt end and a 3' overhang end, a frayed end and a 5' overhang end, a frayed end and a 3' overhang end, two 5' overhang ends, two 3' overhang ends, a 5' overhang end and a 3' overhang end, two frayed ends, or two blunt ends. Typically, when present, overhangs are located at the 3' terminal ends of the sense strand, the antisense strand, or both the sense strand and the antisense strand.

The ALK7 RNAi agents disclosed herein may also be comprised of one or more modified nucleotides. In some embodiments, substantially all of the nucleotides of the sense strand and substantially all of the nucleotides of the antisense strand of the ALK7 RNAi agent are modified nucleotides. The ALK7 RNAi agents disclosed herein may further be comprised of one or more modified internucleoside linkages, e.g., one or more phosphorothioate or phosphorodithioate linkages. In some embodiments, an ALK7 RNAi agent contains one or more modified nucleotides and one or more modified internucleoside linkages. In some embodiments, a 2'-modified nucleotide is combined with modified internucleoside linkage.

In some embodiments, an ALK7 RNAi agent is prepared or provided as a salt, mixed salt, or a free-acid. In some embodiments, an ALK7 RNAi agent is prepared as a pharmaceutically acceptable salt. In some embodiments, an ALK7 RNAi agent is prepared as a pharmaceutically acceptable sodium salt. Such forms that are well known in the art are within the scope of the inventions disclosed herein.

Modified Nucleotides

Modified nucleotides, when used in various oligonucleotide constructs, can preserve activity of the compound in cells while at the same time increasing the serum stability of these compounds, and can also minimize the possibility of activating interferon activity in humans upon administration of the oligonucleotide construct.

In some embodiments, an ALK7 RNAi agent contains one or more modified nucleotides. As used herein, a "modified nucleotide" is a nucleotide other than a ribonucleotide (2'-hydroxyl nucleotide). In some embodiments, at least 50% (e.g., at least 60%, at least 70%, at least 80%, at least 90%, at least 95%, at least 97%, at least 98%, at least 99%, or 100%) of the nucleotides are modified nucleotides. As used herein, modified nucleotides can include, but are not limited to, deoxyribonucleotides, nucleotide mimics, abasic nucleotides, 2'-modified nucleotides, inverted nucleotides, modified nucleobase-comprising nucleotides, bridged nucleotides, peptide nucleic acids (PNAs), 2',3'-seco nucleotide mimics (unlocked nucleobase analogues), locked nucleotides, 3'-O-methoxy (2' internucleoside linked) nucleotides, 2'-F-Arabino nucleotides, 5'-Me, 2'-fluoro nucleotide, morpholino nucleotides, vinyl phosphonate deoxyribonucleotides, vinyl phosphonate containing nucleotides, and cyclopropyl phosphonate containing nucleotides. 2'-modified nucleotides (i.e., a nucleotide with a group other than a hydroxyl group at the 2' position of the five-membered sugar ring) include, but are not limited to, 2'-O-methyl nucleotides (also referred to herein or in the art as 2'-methoxy nucleotides), 2'-fluoro nucleotides (also referred to herein or in the art as 2'-deoxy-2'-fluoro nucleotides), 2'-deoxy nucleotides, 2'-methoxyethyl (2'-O-2-methoxylethyl) nucleotides (also referred herein or in the art as 2'-MOE nucleotides), 2'-amino nucleotides, and 2'-alkyl nucleotides. It is not necessary for all positions in a given compound to be uniformly modified. Conversely, more than one modification can be incorporated in a single ALK7 RNAi agent or even in a single nucleotide thereof. The ALK7 RNAi agent sense strands and antisense strands can be synthesized and/or modified by methods known in the art. Modification at one nucleotide is independent of modification at another nucleotide.

Modified nucleobases include synthetic and natural nucleobases, such as 5-substituted pyrimidines, 6-azapyrimidines and N-2, N-6 and 0-6 substituted purines, (e.g., 2-aminopropyladenine, 5-propynyluracil, or 5-propynylcytosine), 5-methylcytosine (5-me-C), 5-hydroxymethyl cytosine, inosine, xanthine, hypoxanthine, 2-aminoadenine, 6-alkyl (e.g., 6-methyl, 6-ethyl, 6-isopropyl, or 6-n-butyl) derivatives of adenine and guanine, 2-alkyl (e.g., 2-methyl, 2-ethyl, 2-isopropyl, or 2-n-butyl) and other alkyl derivatives of adenine and guanine, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7-methylguanine and 7-methyladenine, 8-azaguanine and 8-azaadenine, 7-deazaguanine, 7-deazaadenine, 3-deazaguanine, and 3-deazaadenine.

In some embodiments, the 5' and/or 3' end of the antisense strand can include abasic residues (Ab), which can also be referred to as an "abasic site" or "abasic nucleotide." An abasic residue (Ab) is a nucleotide or nucleoside that lacks a nucleobase at the 1' position of the sugar moiety. (See, e.g., U.S. Pat. No. 5,998,203). In some embodiments, an abasic residue can be placed internally in a nucleotide sequence. In some embodiments, Ab or AbAb can be added to the 3' end of the antisense strand. In some embodiments, the 5' end of the sense strand can include one or more additional abasic residues (e.g., (Ab) or (AbAb)). In some embodiments, UUAb, UAb, or Ab are added to the 3' end of the sense strand. In some embodiments, an abasic (deoxyribose) residue can be replaced with a ribitol (abasic ribose) residue.

In some embodiments, all or substantially all of the nucleotides of an RNAi agent are modified nucleotides. As used herein, an RNAi agent wherein substantially all of the nucleotides present are modified nucleotides is an RNAi agent having four or fewer (i.e., 0, 1, 2, 3, or 4) nucleotides in both the sense strand and the antisense strand being ribonucleotides (i.e., unmodified). As used herein, a sense strand wherein substantially all of the nucleotides present are modified nucleotides is a sense strand having two or fewer (i.e., 0, 1, or 2) nucleotides in the sense strand being unmodified ribonucleotides. As used herein, an antisense strand wherein substantially all of the nucleotides present are modified nucleotides is an antisense strand having two or fewer (i.e., 0, 1, or 2) nucleotides in the antisense strand being unmodified ribonucleotides. In some embodiments, one or more nucleotides of an RNAi agent is an unmodified ribonucleotide. Chemical structures for certain modified nucleotides are set forth in Table 11 herein.

Modified Internucleoside Linkages

In some embodiments, one or more nucleotides of an ALK7 RNAi agent are linked by non-standard linkages or backbones (i.e., modified internucleoside linkages or modified backbones). Modified internucleoside linkages or backbones include, but are not limited to, phosphorothioate groups (represented herein as a lower case "s"), chiral phosphorothioates, thiophosphates, phosphorodithioates (represented herein as lower case "ss"), phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some embodiments, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide backbones, sulfoxide backbones, sulfone backbones, formacetyl and thioformacetyl backbones, methylene formacetyl and thioformacetyl backbones, alkene-containing backbones, sulfamate backbones, methyleneimino and methylenehydrazino backbones, sulfonate and sulfonamide backbones, amide backbones, and other backbones having mixed N, O, S, and $CH_2$ components.

In some embodiments, a sense strand of an ALK7 RNAi agent can contain 1, 2, 3, 4, 5, or 6 phosphorothioate or phosphorodithioate linkages, an antisense strand of an ALK7 RNAi agent can contain 1, 2, 3, 4, 5, or 6 phosphorothioate or phosphorodithioate linkages, or both the sense strand and the antisense strand independently can contain 1, 2, 3, 4, 5, or 6 phosphorothioate or phosphorodithioate linkages. In some embodiments, a sense strand of an ALK7 RNAi agent can contain 1, 2, 3, or 4 phosphorothioate or phosphorodithioate linkages, an antisense strand of an ALK7 RNAi agent can contain 1, 2, 3, or 4 phosphorothioate or phosphorodithioate linkages, or both the sense strand and the antisense strand independently can contain 1, 2, 3, or 4 phosphorothioate or phosphorodithioate linkages.

In some embodiments, an ALK7 RNAi agent sense strand contains at least two phosphorothioate internucleoside linkages. In some embodiments, the phosphorothioate internucleoside linkages are between the nucleotides at positions 1-3 from the 3' end of the sense strand. In some embodiments, one phosphorothioate internucleoside linkage is at the 5' end of the sense strand nucleotide sequence, and another phosphorothioate or phosphorodithioate linkage is at the 3' end of the sense strand nucleotide sequence. In some embodiments, two phosphorothioate internucleoside linkage are located at the 5' end of the sense strand, and another phosphorothioate or phosphorodithioate linkage is at the 3' end of the sense strand. In some embodiments, the sense strand does not include any phosphorothioate internucleoside linkages between the nucleotides, but contains one, two, or three phosphorothioate or phosphorodithioate linkages between the terminal nucleotides on both the 5' and 3' ends and the optionally present inverted abasic residue terminal caps. In some embodiments, a targeting ligand is linked to the sense strand via a phosphorothioate or phosphorodithioate linkage.

In some embodiments, an ALK7 RNAi agent antisense strand contains four phosphorothioate internucleoside linkages. In some embodiments, the four phosphorothioate internucleoside linkages are between the nucleotides at positions 1-3 from the 5' end of the antisense strand and between the nucleotides at positions 19-21, 20-22, 21-23, 22-24, 23-25, or 24-26 from the 5' end. In some embodiments, three phosphorothioate internucleoside linkages are located between positions 1~4 from the 5' end of the antisense strand, and a fourth phosphorothioate internucleoside linkage is located between positions 20-21 from the 5' end of the antisense strand. In some embodiments, an ALK7 RNAi agent contains at least three or four phosphorothioate internucleoside linkages in the antisense strand.

Capping Residues or Moieties

In some embodiments, the sense strand may include one or more capping residues or moieties, sometimes referred to in the art as a "cap," a "terminal cap," or a "capping residue." As used herein, a "capping residue" is a non-nucleotide compound or other moiety that can be incorporated at one or more termini of a nucleotide sequence of an RNAi agent disclosed herein. A capping residue can provide the RNAi agent, in some instances, with certain beneficial properties, such as, for example, protection against exonuclease degradation. In some embodiments, inverted abasic residues (invAb) (also referred to in the art as "inverted abasic sites") are added as capping residues (see Table 11). (See, e.g., F. Czauderna, Nucleic Acids Res., 2003, 31 (11), 2705-16). Capping residues are generally known in the art, and include, for example, inverted abasic residues as well as carbon chains such as a terminal $C_3H_7$ (propyl), $C_6H_{13}$ (hexyl), or $C_{12}H_{25}$ (dodecyl) groups. In some embodiments, a capping residue is present at either the 5' terminal end, the 3' terminal end, or both the 5' and 3' terminal ends of the sense strand. In some embodiments, the 5' end and/or the 3' end of the sense strand may include more than one inverted abasic deoxyribose moiety as a capping residue.

In some embodiments, one or more inverted abasic residues (invAb) are added to the 3' end of the sense strand. In some embodiments, one or more inverted abasic residues (invAb) are added to the 5' end of the sense strand. In some embodiments, one or more inverted abasic residues or inverted abasic sites are inserted between a targeting ligand and the nucleotide sequence of the sense strand of the RNAi agent. In some embodiments, the inclusion of one or more inverted abasic residues or inverted abasic sites at or near the terminal end or terminal ends of the sense strand of an RNAi agent allows for enhanced activity or other desired properties of an RNAi agent.

In some embodiments, one or more inverted abasic residues (invAb) are added to the 5' end of the sense strand. In some embodiments, one or more inverted abasic residues can be inserted between a targeting ligand and the nucleotide sequence of the sense strand of the RNAi agent. The inverted abasic residues may be linked via phosphate, phosphorothioate (e.g., shown herein as (invAb) s)), or other internucleoside linkages. In some embodiments, the inclusion of one or more inverted abasic residues at or near the terminal end or terminal ends of the sense strand of an RNAi agent may allow for enhanced activity or other desired properties of an RNAi agent. In some embodiments, an inverted abasic (deoxyribose) residue can be replaced with an inverted ribitol (abasic ribose) residue. In some embodiments, the 3' end of the antisense strand core stretch sequence, or the 3' end of the antisense strand sequence, may include an inverted abasic residue. The chemical structures for inverted abasic deoxyribose residues are shown in Table 11 below.

ALK7 RNAi Agents

The ALK7 RNAi agents disclosed herein are designed to target specific positions on an ALK7 gene (e.g., SEQ ID NO:1 (NM_145259.3)). As defined herein, an antisense strand sequence is designed to target an ALK7 gene at a given position on the gene when the 5' terminal nucleobase of the antisense strand is aligned with a position that is 21 nucleotides downstream (towards the 3' end) from the position on the gene when base pairing to the gene. For example, as illustrated in Tables 1 and 2 herein, an antisense strand sequence designed to target an ALK7 gene at position 304 requires that when base pairing to the gene, the 5' terminal nucleobase of the antisense strand is aligned with position 324 of an ALK7 gene.

As provided herein, an ALK7 RNAi agent does not require that the nucleobase at position 1 (5'→3') of the antisense strand be complementary to the gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. For example, for an ALK7 RNAi agent disclosed herein that is designed to target position 304 of an ALK7 gene, the 5' terminal nucleobase of the antisense strand of the ALK7 RNAi agent must be aligned with position 324 of the gene; however, the 5' terminal nucleobase of the antisense strand may be, but is not required to be, complementary to position 324 of an ALK7 gene, provided that there is at least 85% complementarity (e.g., at least 85, 86, 87, 88, 89, 90, 91, 92, 93, 94, 95, 96, 97, 98, 99, or 100% complementarity) of the antisense strand and the gene transcript across a core stretch sequence of at least 16 consecutive nucleotides. As shown by, among other things, the various examples disclosed herein, the specific site of binding of the gene by the antisense strand of the ALK7 RNAi agent (e.g., whether the ALK7 RNAi agent is designed to target an ALK7 gene at position 304, at position 264, at position 785, or at some other position) is an important factor to the level of inhibition achieved by the ALK7 RNAi agent. (See, e.g., Kamola et al., *The siRNA Non-seed Region and Its Target Sequences are Auxiliary Determinants of Off-Target Effects*, PLOS Computational Biology, 11 (12), FIG. 1 (2015)).

In some embodiments, the ALK7 RNAi agents disclosed herein target an ALK7 gene at or near the positions of the ALK7 sequence shown in Table 1. In some embodiments, the antisense strand of an ALK7 RNAi agent disclosed herein includes a core stretch sequence that is fully, substantially, or at least partially complementary to a target ALK7 19-mer sequence disclosed in Table 1.

TABLE 1

ALK7 19-mer mRNA Target Sequences (taken from *homo sapiens* Activin Receptor-Like Kinase 7 (ALK7) transcript, GenBank NM_145259.3 (SEQ ID NO: 1))

| SEQ ID No. | ALK7 19-mer Target Sequences (5'→3') | Corresponding Positions of Sequence on SEQ ID NO: 1 | Targeted Gene Position (as referred to herein) |
|---|---|---|---|
| 2 | ACUGAAGUGUGUAUGUCUU | 295-313 | 293 |
| 3 | AACAGAAGGAGCAUGUUGG | 343-361 | 341 |
| 4 | GUCAUGCUAACCAAUGGAA | 368-386 | 366 |
| 5 | CUUCUGUCAUAGUUCCAAC | 439-457 | 437 |
| 6 | CUGUCAUAGUUCCAACAAU | 442-460 | 440 |
| 7 | UGGUAUCUGAAUAUCAUGA | 1023-1041 | 1021 |
| 8 | AACAGGGCUCCUUAUAUGA | 1041-1059 | 1039 |
| 9 | GUCUGGCACACCUUCAUAU | 1125-1143 | 1123 |
| 10 | CUGGCACACCUUCAUAUGG | 1127-1145 | 1125 |

TABLE 1-continued

ALK7 19-mer mRNA Target Sequences (taken from *homo sapiens* Activin Receptor-Like Kinase 7 (ALK7) transcript, GenBank NM_145259.3 (SEQ ID NO: 1))

| SEQ ID No. | ALK7 19-mer Target Sequences (5'→3') | Corresponding Positions of Sequence on SEQ ID NO: 1 | Targeted Gene Position (as referred to herein) |
|---|---|---|---|
| 11 | GGCACACCUUCAUAUGGAG | 1129-1147 | 1127 |
| 12 | ACAAGGUAAACCUGCUAUU | 1159-1177 | 1157 |
| 13 | AGGUAAACCUGCUAUUGCU | 1162-1180 | 1160 |
| 14 | GUGCCAUAGCGGACUUAGG | 1230-1248 | 1228 |
| 15 | CUGUGAAGCAUGAUUCAAU | 1254-1272 | 1252 |
| 16 | UGUGAAGCAUGAUUCAAUA | 1255-1273 | 1253 |
| 17 | AAUACUGAACACUAUCGAC | 1270-1288 | 1268 |
| 18 | UCGACAUACCUCAGAAUCC | 1284-1302 | 1282 |
| 19 | UGAAAUGCUUGAUGAUACA | 1333-1351 | 1331 |
| 20 | AAUGCUUGAUGAUACAAUG | 1336-1354 | 1334 |
| 21 | CGAGCUGACAUCUAUUCUG | 1382-1400 | 1380 |
| 22 | CUGUUGGUCUGGUUUACUG | 1398-1416 | 1396 |
| 23 | GUUGAGGAGUACCAAUUGC | 1451-1469 | 1449 |
| 24 | UCAGAUCCCUCGAUAGAGG | 1490-1508 | 1488 |
| 25 | AUCCCUCGAUAGAGGAAAU | 1494-1512 | 1492 |
| 26 | AAGUUUCGACCAAGUAUCC | 1535-1553 | 1533 |
| 27 | ACUGCUCUUCGUAUUAAGA | 1640-1658 | 1638 |

*Homo sapiens* activin A receptor type 1C, ACVR1C, also known as ALK7, GenBank NM_145259.3 (SEQ ID NO:1), gene transcript (8853 bases):

```
  1 agtggcagga gcgccgcgca ccgccagccg cagggggcgt gggatggggg cggccgggga
 61 ggggggcgcc cacactgact agagccaacc gcgcacttca aaagggtgtc ggtgccgcgc
121 tcccctcccg cggcccggga acttcaaagc gggccgtgct gccccggctg cctcgctctg
181 ctctggggcc tcgcagcccc ggcgcggccg cctggtggcg atgacccggg cgctctgctc
241 agcgctccgc caggctctcc tgctgctcgc agcggccgcc gagctctcgc caggactgaa
301 gtgtgtatgt cttttgtgtg attcttcaaa cttcacctgc caaacagaag gagcatgttg
361 ggcatcagtc atgctaacca atggaaaaga gcaggtgatc aaatcctgtg tctcccttcc
421 agaactgaat gctcaagtct tctgtcatag ttccaacaat gttaccaaaa ccgaatgctg
481 cttcacagat ttttgcaaca acataacact gcaccttcca acagcatcac caaatgcccc
541 aaaacttgga cccatggagc tggccatcat tattactgtg cctgtttgcc tcctgtccat
601 agctgcgatg ctgacagtat gggcatgcca gggtcgacag tgctcctaca ggaagaaaaa
661 gagaccaaat gtggaggaac cactctctga gtgcaatctg gtaaatgctg gaaaaactct
721 gaaagatctg atttatgatg tgaccgcctc tggatctggc tctggtctac ctctgttggt
781 tcaaaggaca attgcaagga cgattgtgct tcaggaaata gtaggaaaag gtagatttgg
841 tgaggtgtgg catggaagat ggtgtgggga agatgtggct gtgaaaatat tctcctccag
901 agatgaaaga tcttggtttc gtgaggcaga aatttaccag acggtcatgc tgcgacatga
```

-continued 961 aaacatcctt ggtttcattg ctgctgacaa caaagataat ggaacttgga ctcaactttg
1021 gctggtatct gaatatcatg aacagggctc cttatatgac tatttgaata gaaatatagt
1081 gaccgtggct ggaatgatca agctggcgct ctcaattgct agtggtctgg cacaccttca
1141 tatggagatt gttggtacac aaggtaaacc tgctattgct catcgagaca taaaatcaaa
1201 gaatatctta gtgaaaaagt gtgaaacttg tgccatagcg gacttagggt tggctgtgaa
1261 gcatgattca atactgaaca ctatcgacat acctcagaat cctaaagtgg gaaccaagag
1321 gtatatggct cctgaaatgc ttgatgatac aatgaatgtg aatatctttg agtccttcaa
1381 acgagctgac atctattctg ttggtctggt ttactgggaa atagcccgga ggtgttcagt
1441 cggaggaatt gttgaggagt accaattgcc ttattatgac atggtgcctt cagatccctc
1501 gatagaggaa atgagaaagg ttgtttgtga ccagaagttt cgaccaagta tcccaaacca
1561 gtggcaaagt tgtgaagcac tccgagtcat ggggagaata atgcgtgagt gttggtatgc
1621 caacggagcg gcccgcctaa ctgctcttcg tattaagaag actatatctc aactttgtgt
1681 caaagaagac tgcaaagcct aatgatgata attatgttaa aaagaaatct ctcatagctt
1741 tcttttccat tttccccttt atgtgaatgt tttgccatt tttttttgt tctacctcaa
1801 agataagaca gtacagtatt taagtgccca taaggcagca tgaaaagata actctaaagt
1861 taagcatggg caggagttga cttcatccaa tctctatgtt atgtttaatt ttattttgaa
1921 agcaacacct caactcatct ttttatttaa taaggaagaa atatattaca aaagtataaa
1981 ataagctcta taaaaatgtt atagtcatta agtttttatt ttacttgaac caagagcaca
2041 tgaatgaaca ggaaaagatg taaaaacatt tttttctgag atgaaaacat attaattaaa
2101 catgcaaatt agagcatgct atctttaggt gatgcaatct atgtttcccc ctttttaagt
2161 tagcaggact ttttaaaaat aaatattgct ctaaacttta atatatcgaa cgtgagagtg
2221 gagctgctta gtggaagatg taagtgaggt gggtgtccca tgtgcttggt ctccccttct
2281 gctgttctcc tgttcttcat aatccactac tgcagcagtc cctgaaccac taaacttgtt
2341 cctttcattt acaaaagaga tacctgacat cctgagacac tgagaaatgt cctgaagtca
2401 cacagctaat ggcagaactg gcactaggtc caaatcttgt gataatgaac accgtaaggt
2461 tagctagctt cctactttcc cttgaatagt gcttttctcc ctatgtaata tcttttatta
2521 tgatatttgt ggtttagaag gcatattgag ttattttgca gaatcataat ggacccgcac
2581 aaaatctcag aaccatatct gttgacattt tttctcatag aaatatcatg gttaccccat
2641 ttgttaatga gcattaatgt tttctgaaca cttccaaaga ttaatcaaac ataaatattc
2701 attgtctgaa aatgtcttta agatacaatt cagaggtccc tatttccttt gtacatacac
2761 acttagaaag aaaagacaga aaaggaagag gaaggaagga aatattttga gaatatattg
2821 agaagaatta agaaaactct tcaatgaagt gttaacaacc aaaccctaca gacggtatca
2881 gaaacagcaa atagatattc ctctaccctt tcacagtgag tgagtgagta cagaagaatg
2941 ctcatgatag ttttgccttc attctacttt ctgtggacac agagtaatga atatttaatg
3001 ggacattaaa tatgcccttc aaatctataa ttttactttg gtaaacgaga tttaacatga
3061 tgtcttttat gctcctaaaa catctttttt caaactccat tccttagaac attcttctac
3121 tgagatgatc caagaccaaa agtgttcttt ggtacttgct tataaagtga tagtacatgt
3181 tagcatataa tgtattttga agagtgaagt aaatgctatt gataacagta aaaaaaaaaa
3241 aaaaaactaa taacagtaaa gaaatgctac ttgatttttt tttaaactgg attgctcaga
3301 ttacctgatc gtggtggaac ccttttatta agaggagggg aaacttttta ctatcccata -continued

```
3361  tttaactgtt ctataaagca aagcacagct tgggtaatag cgttctgaag gatatacttc
3421  tgtattttct catagagtac aatttagtga ttatgcttca tttcactatg gaaatatgtt
3481  actgaatcta tcttcatttt actgagttga aataaggaag gcaaaaaact gacagctatg
3541  gagtttgcgt gtacttccat actcgttaat gctctcatcc acttattaaa taatcataga
3601  gcacccatat cttgcttgcc acaatatcgg gtacaagagg gaatacaaag atagataggt
3661  cctgccctca gggattttaa agtctaattt gggaatggga atagggatgt gagtgtgtgg
3721  gggaagagat taaattgaca gataaaatac gaagtgggat gtcttgagtt ctgcatgaca
3781  gtgggtttct aggataggtc tgaaaattgc tttcatttgc aacacattta gaaagtagct
3841  ttatttggat attacagaca atctaaatat atcatcagtt tttaaaagtg cctatgtgaa
3901  gtgattttta aaaagagcct atgtgaaggg gtaatcttgc ttgttcttgt tactaatttc
3961  tcatagattg tttttctgca tatataagaa cgaaattatt tatttactat ggttgtacgt
4021  gcctcaaata aacaagaatg atatttcctg ttttatttac ttatgttggg taaatatgct
4081  tattgaattt ttaagagagg attttttacc atctccattt ttcttgtcat tatgttttgt
4141  agcttatttg agggtgtcta aatataattt catattttat tggttcaact ttcactctga
4201  agaaatccgt atgttagtac attttgaggt atttttcttg ttcttgtgtt gtttaactat
4261  gactcctaac tgagtagtct tatatttcaa ttacaaaata catttttttaa gaaagggaat
4321  agagcagcaa aaatgataag gaaaatgtta aaagttgtaa tatttccttt actcttaaca
4381  ggattatata tagaacatgc tcacttacaa aaataggatg atgaagttta gagcataagg
4441  caggcttctt gtatatactt atgctgtcaa atgttatatt gtttttaatg gagtcccatt
4501  gtgtaatatt tatttctttt acattttgtt ataagcaaaa aaaaaaaaaa ttctccttag
4561  gttatgttca gagtatcagt gttctttact ccttacagat attttggctt tggggtataa
4621  tacaagactt gggaaaacac tattatgaat tttcagtact gtataaagtg gtgatgggat
4681  ttaaatgcag catcactttc tgaaaataag agaaacatta tttgttgtca gtatttcagc
4741  atgaacttgt tgccttgtaa attttgcctt taagtttgta attggtacag attctgttgt
4801  atgctttctt ctatgtctaa aatatttggc atgtcacatc tagaattctt aatttatgtt
4861  ctgacttgag agttaagtga aacatgactg tcgtgcacta ttttaggcat agcacttgct
4921  tttcatcttt atactttcaa ttaactttgc attttaaatt tccatgattg tatgaaaata
4981  gtaacctggt tgcagtatct gaaaaaatta aaattagctt ttatttaaaa atgaaaatct
5041  acaatagatt cattaggtta gaagttccag aataatttat tattttatta cacctactat
5101  tgtagaatta ctaataaaac aaaacaaaac tactcctatt ttcctggaat tttgccacca
5161  tgtgacttat tggggcagag aaaactcagg gttgtctttg agtctgcaca aaagcaccag
5221  ggaacctgct tagcaaatcg tctgaaaaca gggagctgat gtttgccatt atacaaagtt
5281  tgagtaaaca acttaaaatt gcttgttagg gcatagtctt tgattgaaat aagtatgaga
5341  atgtatttgg ctaaataaat gtatttaaaa tatacaaatt ttatttccca ctggaaaatt
5401  aagaaagtag cagtaccaaa tgaataaaag ctggcagttg atgtcttcaa taatcattcc
5461  tttaaaataa attcacaaac acatcattac aagctactta gaaatgttta gtattcgtat
5521  cttaaaatgg caccattgtg gttttcaaag atattttaaa catcttttgt gaaacatact
5581  atttctgttt gacaatgctt tgttctagct ctgtgtgctg atacctacat ggagtttttc
5641  tgctatttta gtgaaaacag taattctttt atcttgagag ctgcttctaa ataacaaaaa
5701  agttaattgg aatgtaagtt tttaaaaaat gttaatatta aatagaattt ttataatatg
5761  ggcattttttc aaaacatttt aatgaaaata tatagatatt tgactttctt tttttcatct
```

-continued 5821 agccttgctt tatatttcat tatttttctc acttttttc ttaatattcc ctcactatct
5881 ttcaacatta tcattagttc ctaattttaa aaataactct tatttaactt aaccgtctgg
5941 aatttagcct tctaatgaaa gagaatccct tagtactctc agagattata taaagttatt
6001 ccaattttgt gtagatgacg aaaccaagga tcagagatta aatgactact agttactagc
6061 agaactctta tgaaagcctg gtggtgacac ccagcactgt tccctgccat atccccaact
6121 tttactgatt aaaaattaat tcgcatgcat ctaaacctac cttgaatgca cactaacgta
6181 atgtgccatt caatgatgat gataaaatcc cacttttctt tgggtttcta ctaaaataat
6241 ttactcactc agagtgaggt caatgagaaa aactaaacta ggctaagaaa gagttgtaga
6301 atggttgttg agctaagtag gcaaccactg gggtgctgat aaaattaatg gataaaattt
6361 aggaactgtg agagtataga atttcttagt gcaagtaatg attagagaag cttcctgaca
6421 tcccccaccc tttctgtaag gactgttctt tctctttgta ccttggaatg ggggtgaaag
6481 gtgatttgat agctgaattt gggactatgt ccagtgggat attatctaac ttttctctct
6541 ttctcttttt tttcccctca gtttctcatt agtttgtctt tggcattcat cttcttttag
6601 tgcattaaaa aatgtttggc agatctcatc aatcccaagt cactctataa ttcctgtatt
6661 tctttagttg tcgtttaacc tgtccaaact tctacacaat gaacttctta acaagatttt
6721 aagttctctg tataagaggt ttcacctcat aacttctcca gtaatccttc atttggcact
6781 atagagtatt tgttaatggc agagatgatt tttcttttaa aacctaaaaa gactagctgt
6841 tatttgtatt ctagctttta gctaacatat aaagaatgtc tacttttgct ttaatgctaa
6901 attccgcttg agaaatagta actgggaaag acaatttgaa atatatgccc cataatgtga
6961 ttgttaaatt tatttctgct gttccatacc attgctttgt tttgcttttg acaaactaag
7021 ccattatgct attagtttgg aatataatac tacagcaaaa ttaggtaaca atccctattt
7081 taaaattccc ctaacaataa tagaactgcc agcatacttt tctctttcag ttgtagatga
7141 atacattcga gagaatatga gctgtatttc atcctagatt ttaatatttt cagatgtgac
7201 tgtatttcct gatcattggt ccaagttgtc ctaaaagaaa tttttctctc cagacctaac
7261 agttttaact gcaagagttt actgtgggtt atgttaatct gaattttaat agggccacta
7321 agaatctgag tgccttagga gattaccctt atacccactg ccatcacatc cagtcaggcc
7381 tgttgtgctc tatataaatc ttcccagctg aggggcaggt gcgggctaaa atccaactgc
7441 aattggctcc cagacataat tttatatttt acagagaagc atcttattgg cttatatgtg
7501 tttaaagaat ggtctggctt atacatcttc agaaaatgag aattaaaaag tcaaaataat
7561 tcttgacatc tacagattga acaaagaact tagaagaaat aatactttat cttttcatcc
7621 tggcattcct gagagaagag aaattgattg tttatcatgt tggtttaatt tttcaaccca
7681 gacaatctgc agcaaggcac atggacccca attttgatat cgtccataca gttttcattc
7741 tatgcatgga gctaattact gactttgcct gtaaagagag gattgtgtgc ctaaattttg
7801 tctaacaaat gcaagcgtag aatgacattt actaatattt ctatttcttc cataggctaa
7861 ataatagtaa ctaagtattt ttaaggacac agcccttttt ttctctttat acaaaatgag
7921 agtatctgag ccaaaatatt aaattctagt tcttttccgc aatgactagt gtcaagctca
7981 tgtactcttc tgattctaga ctggagaaga ttattcaaac ttgatctgtg tttcaggttt
8041 ttaaatgtcc taaaaacaga aaattagatt cagatctcaa aaaaggaatt ttggattgac
8101 tttcaaagta ctaatactaa ttatactttt cttttggtag cgtgactctt cttataccta
8161 agaacatatt acaaatgtca aaaccattgc attttgacat tgcaaaacat gccttgaact -continued

```
8221  cttgaactac tgtgaaaaga atcaccgttg taaagacttt ttgtaagcta gctgatactc

8281  ttaagtatgt aaaaagattg tctttcagcc gacaggccca aaggaatgta tataaggaag

8341  gaatatgaaa aaataaatta ggttttaaaa taggaattgg gcaataaact gtatcaaaaa

8401  tatgtagatg gattttagta gttgtaattt aaatgtggaa ggtgaagaga atttcaaact

8461  ccaaagagaa atgaatgata ttcagatgtt tcattaattt ctagtctgtg aaaatatgca

8521  ttttatagta atatgtatag acttatttta tttagaaata atagtgtttt agaatttatt

8581  aaaaactcag tgatagcctt tataccaaaa tgtttaactt taccaacagc aagtcataaa

8641  agtatttatt ttaaagcttt ttaatattat cgtgtaactt tcatctgtct tcagatgtaa

8701  ataattatct gcctaaatgt tatattttta tgtatgcatt ttctgaaaat gtattgtttt

8761  gtaaagtggg aaagataata aatcaagcac ttcttgcact tgtttctgtg aagcatatag

8821  aactctattt taaataaagg aagatgtgtc gta
```

In some embodiments, an ALK7 RNAi agent includes an antisense strand wherein position 19 of the antisense strand (5'→3') is capable of forming a base pair with position 1 of a 19-mer target sequence disclosed in Table 1. In some embodiments, an ALK7 agent includes an antisense strand wherein position 1 of the antisense strand (5'→3') is capable of forming a base pair with position 19 of a 19-mer target sequence disclosed in Table 1.

In some embodiments, an ALK7 agent includes an antisense strand wherein position 2 of the antisense strand (5'→3') is capable of forming a base pair with position 18 of a 19-mer target sequence disclosed in Table 1. In some embodiments, an ALK7 agent includes an antisense strand wherein positions 2 through 18 of the antisense strand (5'→3') are capable of forming base pairs with each of the respective complementary bases located at positions 18 through 2 of the 19-mer target sequence disclosed in Table 1.

For the RNAi agents disclosed herein, the nucleotide at position 1 of the antisense strand (from 5' end→3' end) can be perfectly complementary to an ALK7 gene, or can be non-complementary to an ALK7 gene. In some embodiments, the nucleotide at position 1 of the antisense strand (from 5' end→3' end) is a U, A, or dT. In some embodiments, the nucleotide at position 1 of the antisense strand (from 5' end→3' end) forms an A:U or U:A base pair with the sense strand.

In some embodiments, an ALK7 RNAi agent antisense strand comprises the sequence of nucleotides (from 5' end→3' end) 2-18 or 2-19 of any of the antisense strand sequences in Table 2 or Table 3. In some embodiments, an ALK7 RNAi sense strand comprises the sequence of nucleotides (from 5' end→3' end) 1-17, 1-18, or 2-18 of any of the sense strand sequences in Table 2, Table 4, Table 5, Table 6, or Table 6a.

In some embodiments, an ALK7 RNAi agent is comprised of (i) an antisense strand comprising the sequence of nucleotides (from 5' end→3' end) 2-18 or 2-19 of any of the antisense strand sequences in Table 2 or Table 3, and (ii) a sense strand comprising the sequence of nucleotides (from 5' end→3' end) 1-17 or 1-18 of any of the sense strand sequences in Table 2, Table 4, Table 5, Table 6, or Table 6a.

In some embodiments, the ALK7 RNAi agents include core 19-mer nucleotide sequences shown in the following Table 2.

TABLE 2

ALK7 RNAi Agent Antisense Strand and Sense Strand Core Stretch Base Sequences (N = any nucleobase; I = inosine (hypoxanthine nucleobase)

| SEQ ID NO:. | Antisense Strand Base Sequence (5'→3') (Shown as an Unmodified Nucleotide Sequence) | SEQ ID NO:. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 28 | AAGACAUACACACUUCAGU | 145 | ACUGAAGUGUGUAUGUCUU | 295-313 | 293 |
| 29 | UAGACAUACACACUUCAGU | 146 | ACUGAAGUGUGUAUGUCUA | 295-313 | 293 |
| 30 | NAGACAUACACACUUCAGU | 147 | ACUGAAGUGUGUAUGUCUN | 295-313 | 293 |
| 31 | NAGACAUACACACUUCAGN | 148 | NCUGAAGUGUGUAUGUCUN | 295-313 | 293 |
| 32 | CCAACAUGCUCCUUCUGUU | 149 | AACAGAAGGAGCAUGUUGG | 343-361 | 341 |
| 33 | UCAACAUGCUCCUUCUGUU | 150 | AACAGAAGGAGCAUGUUGA | 343-361 | 341 |
| 34 | ACAACAUGCUCCUUCUGUU | 151 | AACAGAAGGAGCAUGUUGU | 343-361 | 341 |
| 35 | NCAACAUGCUCCUUCUGUU | 152 | AACAGAAGGAGCAUGUUGN | 343-361 | 341 |
| 36 | NCAACAUGCUCCUUCUGUN | 153 | NACAGAAGGAGCAUGUUGN | 343-361 | 341 |

TABLE 2-continued

ALK7 RNAi Agent Antisense Strand and Sense Strand Core Stretch Base Sequences (N = any nucleobase; I = inosine (hypoxanthine nucleobase)

| SEQ ID NO:. | Antisense Strand Base Sequence (5'→3') (Shown as an Unmodified Nucleotide Sequence) | SEQ ID NO:. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 37 | UUCCAUUGGUUAGCAUGAC | 154 | GUCAUGCUAACCAAUGGAA | 368-386 | 366 |
| 38 | AUCCAUUGGUUAGCAUGAC | 155 | GUCAUGCUAACCAAUGGAU | 368-386 | 366 |
| 39 | NUCCAUUGGUUAGCAUGAC | 156 | GUCAUGCUAACCAAUGGAN | 368-386 | 366 |
| 40 | NUCCAUUGGUUAGCAUGAN | 157 | NUCAUGCUAACCAAUGGAN | 368-386 | 366 |
| 41 | GUUGGAACUAUGACAGAAG | 158 | CUUCUGUCAUAGUUCCAAC | 439-457 | 437 |
| 42 | UUUGGAACUAUGACAGAAG | 159 | CUUCUGUCAUAGUUCCAAA | 439-457 | 437 |
| 43 | AUUGGAACUAUGACAGAAG | 160 | CUUCUGUCAUAGUUCCAAU | 439-457 | 437 |
| 44 | NUUGGAACUAUGACAGAAG | 161 | CUUCUGUCAUAGUUCCAAN | 439-457 | 437 |
| 45 | NUUGGAACUAUGACAGAAN | 162 | NUUCUGUCAUAGUUCCAAN | 439-457 | 437 |
| 46 | AUUGUUGGAACUAUGACAG | 163 | CUGUCAUAGUUCCAACAAU | 442-460 | 440 |
| 47 | UUUGUUGGAACUAUGACAG | 164 | CUGUCAUAGUUCCAACAAA | 442-460 | 440 |
| 48 | NUUGUUGGAACUAUGACAG | 165 | CUGUCAUAGUUCCAACAAN | 442-460 | 440 |
| 49 | NUUGUUGGAACUAUGACAN | 166 | NUGUCAUAGUUCCAACAAN | 442-460 | 440 |
| 50 | UCAUGAUAUUCAGAUACCA | 167 | UGGUAUCUGAAUAUCAUGA | 1023-1041 | 1021 |
| 51 | ACAUGAUAUUCAGAUACCA | 168 | UGGUAUCUGAAUAUCAUGU | 1023-1041 | 1021 |
| 52 | NCAUGAUAUUCAGAUACCA | 169 | UGGUAUCUGAAUAUCAUGN | 1023-1041 | 1021 |
| 53 | NCAUGAUAUUCAGAUACCN | 170 | NGGUAUCUGAAUAUCAUGN | 1023-1041 | 1021 |
| 54 | UCAUAUAAGGAGCCCUGUU | 171 | AACAGGGCUCCUUAUAUGA | 1041-1059 | 1039 |
| 55 | ACAUAUAAGGAGCCCUGUU | 172 | AACAGGGCUCCUUAUAUGU | 1041-1059 | 1039 |
| 56 | NCAUAUAAGGAGCCCUGUU | 173 | AACAGGGCUCCUUAUAUGN | 1041-1059 | 1039 |
| 57 | NCAUAUAAGGAGCCCUGUN | 174 | NACAGGGCUCCUUAUAUGN | 1041-1059 | 1039 |
| 58 | AUAUGAAGGUGUGCCAGAC | 175 | GUCUGGCACACCUUCAUAU | 1125-1143 | 1123 |
| 59 | UUAUGAAGGUGUGCCAGAC | 176 | GUCUGGCACACCUUCAUAA | 1125-1143 | 1123 |
| 60 | NUAUGAAGGUGUGCCAGAC | 177 | GUCUGGCACACCUUCAUAN | 1125-1143 | 1123 |
| 61 | NUAUGAAGGUGUGCCAGAN | 178 | NUCUGGCACACCUUCAUAN | 1125-1143 | 1123 |
| 62 | CCAUAUGAAGGUGUGCCAG | 179 | CUGGCACACCUUCAUAUGG | 1127-1145 | 1125 |
| 63 | UCAUAUGAAGGUGUGCCAG | 180 | CUGGCACACCUUCAUAUGA | 1127-1145 | 1125 |
| 64 | ACAUAUGAAGGUGUGCCAG | 181 | CUGGCACACCUUCAUAUGU | 1127-1145 | 1125 |
| 65 | NCAUAUGAAGGUGUGCCAG | 182 | CUGGCACACCUUCAUAUGN | 1127-1145 | 1125 |
| 66 | NCAUAUGAAGGUGUGCCAN | 183 | NUGGCACACCUUCAUAUGN | 1127-1145 | 1125 |
| 67 | CUCCAUAUGAAGGUGUGCC | 184 | GGCACACCUUCAUAUGGAG | 1129-1147 | 1127 |
| 68 | UUCCAUAUGAAGGUGUGCC | 185 | GGCACACCUUCAUAUGGAA | 1129-1147 | 1127 |
| 69 | AUCCAUAUGAAGGUGUGCC | 186 | GGCACACCUUCAUAUGGAU | 1129-1147 | 1127 |
| 70 | NUCCAUAUGAAGGUGUGCC | 187 | GGCACACCUUCAUAUGGAN | 1129-1147 | 1127 |
| 71 | NUCCAUAUGAAGGUGUGCN | 188 | NGCACACCUUCAUAUGGAN | 1129-1147 | 1127 |

TABLE 2-continued

ALK7 RNAi Agent Antisense Strand and Sense Strand Core Stretch Base Sequences (N = any nucleobase; I = inosine (hypoxanthine nucleobase)

| SEQ ID NO:. | Antisense Strand Base Sequence (5'→3') (Shown as an Unmodified Nucleotide Sequence) | SEQ ID NO:. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 72 | AAUAGCAGGUUUACCUUGU | 189 | ACAAGGUAAACCUGCUAUU | 1159-1177 | 1157 |
| 73 | UAUAGCAGGUUUACCUUGU | 190 | ACAAGGUAAACCUGCUAUA | 1159-1177 | 1157 |
| 74 | NAUAGCAGGUUUACCUUGU | 191 | ACAAGGUAAACCUGCUAUN | 1159-1177 | 1157 |
| 75 | NAUAGCAGGUUUACCUUGN | 192 | NCAAGGUAAACCUGCUAUN | 1159-1177 | 1157 |
| 76 | AGCAAUAGCAGGUUUACCU | 193 | AGGUAAACCUGCUAUUGCU | 1162-1180 | 1160 |
| 77 | UGCAAUAGCAGGUUUACCU | 194 | AGGUAAACCUGCUAUUGCA | 1162-1180 | 1160 |
| 78 | NGCAAUAGCAGGUUUACCU | 195 | AGGUAAACCUGCUAUUGCN | 1162-1180 | 1160 |
| 79 | NGCAAUAGCAGGUUUACCN | 196 | NGGUAAACCUGCUAUUGCN | 1162-1180 | 1160 |
| 80 | CCUAAGUCCGCUAUGGCAC | 197 | GUGCCAUAGCGGACUUAGG | 1230-1248 | 1228 |
| 81 | UCUAAGUCCGCUAUGGCAC | 198 | GUGCCAUAGCGGACUUAGA | 1230-1248 | 1228 |
| 82 | ACUAAGUCCGCUAUGGCAC | 199 | GUGCCAUAGCGGACUUAGU | 1230-1248 | 1228 |
| 83 | NCUAAGUCCGCUAUGGCAC | 200 | GUGCCAUAGCGGACUUAGN | 1230-1248 | 1228 |
| 84 | NCUAAGUCCGCUAUGGCAN | 201 | NUGCCAUAGCGGACUUAGN | 1230-1248 | 1228 |
| 85 | AUUGAAUCAUGCUUCACAG | 202 | CUGUGAAGCAUGAUUCAAU | 1254-1272 | 1252 |
| 86 | UUUGAAUCAUGCUUCACAG | 203 | CUGUGAAGCAUGAUUCAAA | 1254-1272 | 1252 |
| 87 | NUUGAAUCAUGCUUCACAG | 204 | CUGUGAAGCAUGAUUCAAN | 1254-1272 | 1252 |
| 88 | NUUGAAUCAUGCUUCACAN | 205 | NUGUGAAGCAUGAUUCAAN | 1254-1272 | 1252 |
| 89 | UAUUGAAUCAUGCUUCACA | 206 | UGUGAAGCAUGAUUCAAUA | 1255-1273 | 1253 |
| 90 | AAUUGAAUCAUGCUUCACA | 207 | UGUGAAGCAUGAUUCAAUU | 1255-1273 | 1253 |
| 91 | NAUUGAAUCAUGCUUCACA | 208 | UGUGAAGCAUGAUUCAAUN | 1255-1273 | 1253 |
| 92 | NAUUGAAUCAUGCUUCACN | 209 | NGUGAAGCAUGAUUCAAUN | 1255-1273 | 1253 |
| 93 | GUCGAUAGUGUUCAGUAUU | 210 | AAUACUGAACACUAUCGAC | 1270-1288 | 1268 |
| 94 | UUCGAUAGUGUUCAGUAUU | 211 | AAUACUGAACACUAUCGAA | 1270-1288 | 1268 |
| 95 | AUCGAUAGUGUUCAGUAUU | 212 | AAUACUGAACACUAUCGAU | 1270-1288 | 1268 |
| 96 | NUCGAUAGUGUUCAGUAUU | 213 | AAUACUGAACACUAUCGAN | 1270-1288 | 1268 |
| 97 | NUCGAUAGUGUUCAGUAUN | 214 | NAUACUGAACACUAUCGAN | 1270-1288 | 1268 |
| 98 | GGAUUCUGAGGUAUGUCGA | 215 | UCGACAUACCUCAGAAUCC | 1284-1302 | 1282 |
| 99 | UGAUUCUGAGGUAUGUCGA | 216 | UCGACAUACCUCAGAAUCA | 1284-1302 | 1282 |
| 100 | AGAUUCUGAGGUAUGUCGA | 217 | UCGACAUACCUCAGAAUCU | 1284-1302 | 1282 |
| 101 | NGAUUCUGAGGUAUGUCGA | 218 | UCGACAUACCUCAGAAUCN | 1284-1302 | 1282 |
| 102 | NGAUUCUGAGGUAUGUCGN | 219 | NCGACAUACCUCAGAAUCN | 1284-1302 | 1282 |
| 103 | UGUAUCAUCAAGCAUUUCA | 220 | UGAAAUGCUUGAUGAUACA | 1333-1351 | 1331 |
| 104 | AGUAUCAUCAAGCAUUUCA | 221 | UGAAAUGCUUGAUGAUACU | 1333-1351 | 1331 |
| 105 | NGUAUCAUCAAGCAUUUCA | 222 | UGAAAUGCUUGAUGAUACN | 1333-1351 | 1331 |
| 106 | NGUAUCAUCAAGCAUUUCN | 223 | NGAAAUGCUUGAUGAUACN | 1333-1351 | 1331 |
| 107 | CAUUGUAUCAUCAAGCAUU | 224 | AAUGCUUGAUGAUACAAUG | 1336-1354 | 1334 |

TABLE 2-continued

ALK7 RNAi Agent Antisense Strand and Sense Strand Core Stretch Base Sequences (N = any nucleobase; I = inosine (hypoxanthine nucleobase)

| SEQ ID NO:. | Antisense Strand Base Sequence (5'→3') (Shown as an Unmodified Nucleotide Sequence) | SEQ ID NO:. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 108 | UAUUGUAUCAUCAAGCAUU | 225 | AAUGCUUGAUGAUACAAUA | 1336-1354 | 1334 |
| 109 | AAUUGUAUCAUCAAGCAUU | 226 | AAUGCUUGAUGAUACAAUU | 1336-1354 | 1334 |
| 110 | NAUUGUAUCAUCAAGCAUU | 227 | AAUGCUUGAUGAUACAAUN | 1336-1354 | 1334 |
| 111 | NAUUGUAUCAUCAAGCAUN | 228 | NAUGCUUGAUGAUACAAUN | 1336-1354 | 1334 |
| 112 | CAGAAUAGAUGUCAGCUCG | 229 | CGAGCUGACAUCUAUUCUG | 1382-1400 | 1380 |
| 113 | UAGAAUAGAUGUCAGCUCG | 230 | CGAGCUGACAUCUAUUCUA | 1382-1400 | 1380 |
| 114 | AAGAAUAGAUGUCAGCUCG | 231 | CGAGCUGACAUCUAUUCUU | 1382-1400 | 1380 |
| 115 | NAGAAUAGAUGUCAGCUCG | 232 | CGAGCUGACAUCUAUUCUN | 1382-1400 | 1380 |
| 116 | NAGAAUAGAUGUCAGCUCN | 233 | NGAGCUGACAUCUAUUCUN | 1382-1400 | 1380 |
| 117 | CAGUAAACCAGACCAACAG | 234 | CUGUUGGUCUGGUUUACUG | 1398-1416 | 1396 |
| 118 | UAGUAAACCAGACCAACAG | 235 | CUGUUGGUCUGGUUUACUA | 1398-1416 | 1396 |
| 119 | AAGUAAACCAGACCAACAG | 236 | CUGUUGGUCUGGUUUACUU | 1398-1416 | 1396 |
| 120 | NAGUAAACCAGACCAACAG | 237 | CUGUUGGUCUGGUUUACUN | 1398-1416 | 1396 |
| 121 | NAGUAAACCAGACCAACAN | 238 | NUGUUGGUCUGGUUUACUN | 1398-1416 | 1396 |
| 122 | GCAAUUGGUACUCCUCAAC | 239 | GUUGAGGAGUACCAAUUGC | 1451-1469 | 1449 |
| 123 | UCAAUUGGUACUCCUCAAC | 240 | GUUGAGGAGUACCAAUUGA | 1451-1469 | 1449 |
| 124 | ACAAUUGGUACUCCUCAAC | 241 | GUUGAGGAGUACCAAUUGU | 1451-1469 | 1449 |
| 125 | NCAAUUGGUACUCCUCAAC | 242 | GUUGAGGAGUACCAAUUGN | 1451-1469 | 1449 |
| 126 | NCAAUUGGUACUCCUCAAN | 243 | NUUGAGGAGUACCAAUUGN | 1451-1469 | 1449 |
| 127 | CCUCUAUCGAGGGAUCUGA | 244 | UCAGAUCCCUCGAUAGAGG | 1490-1508 | 1488 |
| 128 | UCUCUAUCGAGGGAUCUGA | 245 | UCAGAUCCCUCGAUAGAGA | 1490-1508 | 1488 |
| 129 | ACUCUAUCGAGGGAUCUGA | 246 | UCAGAUCCCUCGAUAGAGU | 1490-1508 | 1488 |
| 130 | NCUCUAUCGAGGGAUCUGA | 247 | UCAGAUCCCUCGAUAGAGN | 1490-1508 | 1488 |
| 131 | NCUCUAUCGAGGGAUCUGN | 248 | NCAGAUCCCUCGAUAGAGN | 1490-1508 | 1488 |
| 132 | AUUUCCUCUAUCGAGGGAU | 249 | AUCCCUCGAUAGAGGAAAU | 1494-1512 | 1492 |
| 133 | UUUUCCUCUAUCGAGGGAU | 250 | AUCCCUCGAUAGAGGAAAA | 1494-1512 | 1492 |
| 134 | NUUUCCUCUAUCGAGGGAU | 251 | AUCCCUCGAUAGAGGAAAN | 1494-1512 | 1492 |
| 135 | NUUUCCUCUAUCGAGGGAN | 252 | NUCCCUCGAUAGAGGAAAN | 1494-1512 | 1492 |
| 136 | GGAUACUUGGUCGAAACUU | 253 | AAGUUUCGACCAAGUAUCC | 1535-1553 | 1533 |
| 137 | UGAUACUUGGUCGAAACUU | 254 | AAGUUUCGACCAAGUAUCA | 1535-1553 | 1533 |
| 138 | AGAUACUUGGUCGAAACUU | 255 | AAGUUUCGACCAAGUAUCU | 1535-1553 | 1533 |
| 139 | NGAUACUUGGUCGAAACUU | 256 | AAGUUUCGACCAAGUAUCN | 1535-1553 | 1533 |
| 140 | NGAUACUUGGUCGAAACUN | 257 | NAGUUUCGACCAAGUAUCN | 1535-1553 | 1533 |
| 141 | UCUUAAUACGAAGAGCAGU | 258 | ACUGCUCUUCGUAUUAAGA | 1640-1658 | 1638 |
| 142 | ACUUAAUACGAAGAGCAGU | 259 | ACUGCUCUUCGUAUUAAGU | 1640-1658 | 1638 |

TABLE 2-continued

| ALK7 RNAi Agent Antisense Strand and Sense Strand Core Stretch Base Sequences (N = any nucleobase; I = inosine (hypoxanthine nucleobase) | | | | | |
|---|---|---|---|---|---|
| SEQ ID NO:. | Antisense Strand Base Sequence (5'→3') (Shown as an Unmodified Nucleotide Sequence) | SEQ ID NO:. | Sense Strand Base Sequence (5'→3') (Shown as an Unmodified Nucleotide Sequence) | Corresponding Positions of Identified Sequence on SEQ ID NO: 1 | Targeted Gene Position |
| 143 | NCUUAAUACGAAGAGCAGU | 260 | ACUGCUCUUCGUAUUAAGN | 1640-1658 | 1638 |
| 144 | NCUUAAUACGAAGAGCAGN | 261 | NCUGCUCUUCGUAUUAAGN | 1640-1658 | 1638 |

N = any nucleobase

The ALK7 RNAi agent sense strands and antisense strands that comprise or consist of the nucleotide sequences in Table 2 can be modified nucleotides or unmodified nucleotides. In some embodiments, the ALK7 RNAi agents having the sense and antisense strand sequences that comprise or consist of any of the nucleotide sequences in Table 2 are all or substantially all modified nucleotides.

In some embodiments, the antisense strand of an ALK7 RNAi agent disclosed herein differs by 0, 1, 2, or 3 nucleotides from any of the antisense strand sequences in Table 2. In some embodiments, the sense strand of an ALK7 RNAi agent disclosed herein differs by 0, 1, 2, or 3 nucleotides from any of the sense strand sequences in Table 2.

As used herein, each N listed in a sequence disclosed in Table 2 may be independently selected from any and all nucleobases (including those found on both modified and unmodified nucleotides). In some embodiments, an N nucleotide listed in a sequence disclosed in Table 2 has a nucleobase that is complementary to the N nucleotide at the corresponding position on the other strand. In some embodiments, an N nucleotide listed in a sequence disclosed in Table 2 has a nucleobase that is not complementary to the N nucleotide at the corresponding position on the other strand. In some embodiments, an N nucleotide listed in a sequence disclosed in Table 2 has a nucleobase that is the same as the N nucleotide at the corresponding position on the other strand. In some embodiments, an N nucleotide listed in a sequence disclosed in Table 2 has a nucleobase that is different from the N nucleotide at the corresponding position on the other strand.

Certain modified ALK7 RNAi agent sense and antisense strands are provided in Table 3, Table 4, Table 5, Table 6, Table 6a, and Table 10. Certain modified ALK7 RNAi agent antisense strands, as well as their underlying unmodified nucleobase sequences, are provided in Table 3. Certain modified ALK7 RNAi agent sense strands, as well as their underlying unmodified nucleobase sequences, are provided in Tables 4, 5, and 6. In forming ALK7 RNAi agents, each of the nucleotides in each of the underlying base sequences listed in Tables 3, 4, 5, and 6, as well as in Table 2, above, can be a modified nucleotide.

The ALK7 RNAi agents described herein are formed by annealing an antisense strand with a sense strand. A sense strand containing a sequence listed in Table 2, Table 4, Table 5, Table 6, Table 6a can be hybridized to any antisense strand containing a sequence listed in Table 2 or Table 3, provided the two sequences have a region of at least 85% complementarity over a contiguous 16, 17, 18, 19, 20, or 21 nucleotide sequence.

In some embodiments, an ALK7 RNAi agent antisense strand comprises a nucleotide sequence of any of the sequences in Table 2 or Table 3.

In some embodiments, an ALK7 RNAi agent comprises or consists of a duplex having the nucleobase sequences of the sense strand and the antisense strand of any of the sequences in Table 2, Table 3, Table 4, Table 5, Table 6, Table 6a, or Table 10.

Examples of antisense strands containing modified nucleotides are provided in Table 3. Examples of sense strands containing modified nucleotides are provided in Tables 4, 5 and 6.

As used in Tables 3, 4, 5, 6, 6a, and 10, the following notations are used to indicate modified nucleotides, targeting groups, and linking groups:

A=adenosine-3'-phosphate
C=cytidine-3'-phosphate
G=guanosine-3'-phosphate
U=uridine-3'-phosphate
I=inosine-3'-phosphate
a=2'-O-methyladenosine-3'-phosphate
as 2'-O-methyladenosine-3'-phosphorothioate
c=2'-O-methylcytidine-3'-phosphate
cs=2'-O-methylcytidine-3'-phosphorothioate
g=2'-O-methylguanosine-3'-phosphate
gs=2'-O-methylguanosine-3'-phosphorothioate
i=2'-O-methylinosine-3'-phosphate
is=2'-O-methylinosine-3'-phosphorothioate
t=2'-O-methyl-5-methyluridine-3'-phosphate
ts=2'-O-methyl-5-methyluridine-3'-phosphorothioate
u=2'-O-methyluridine-3'-phosphate
us=2'-O-methyluridine-3'-phosphorothioate
Af=2'-fluoroadenosine-3'-phosphate
Afs=2'-fluoroadenosine-3'-phosporothioate
Cf=2'-fluorocytidine-3'-phosphate
Cfs=2'-fluorocytidine-3'-phosphorothioate
Gf=2'-fluoroguanosine-3'-phosphate
Gfs=2'-fluoroguanosine-3'-phosphorothioate
Tf=2'-fluoro-5'-methyluridine-3'-phosphate
Tfs=2'-fluoro-5'-methyluridine-3'-phosphorothioate
Uf=2'-fluorouridine-3'-phosphate
Ufs=2'-fluorouridine-3'-phosphorothioate
dT=2'-deoxythymidine-3'-phosphate
$A_{UNA}$=2',3'-seco-adenosine-3'-phosphate
$A_{UNA}$s=2',3'-seco-adenosine-3'-phosphorothioate
$C_{UNA}$=2',3'-seco-cytidine-3'-phosphate
$C_{UNA}$s=2',3'-seco-cytidine-3'-phosphorothioate
$G_{UNA}$=2',3'-seco-guanosine-3'-phosphate
$G_{UNA}$s=2',3'-seco-guanosine-3'-phosphorothioate
$U_{UNA}$=2',3'-seco-uridine-3'-phosphate
$U_{UNA}$s=2',3'-seco-uridine-3'-phosphorothioate
a_2N=see Table 11
a_2Ns=see Table 11
(invAb)=inverted abasic deoxyribonucleotide-5'-phosphate, see Table 11

(invAb)s=inverted abasic deoxyribonucleotide-5'-phosphorothioate, see Table 11
s=phosphorothioate linkage
ss=phosphorodithioate linkage
p=terminal phosphate (as synthesized)
vpdN=vinyl phosphonate deoxyribonucleotide
cPrpa=5'-cyclopropyl phosphonate-2'-O-methyladenosine-3'-phosphate (see Table 11)
cPrpas=5'-cyclopropyl phosphonate-2'-O-methyladenosine-3'-phosphorothioate (see Table 11)
cPrpi=5'-cyclopropyl phosphonate-2'-O-methylinosine-3'-phosphate (see Table 11)
cPrpis=5'-cyclopropyl phosphonate-2'-O-methylinosine-3'-phosphorothioate (see Table 11)
cPrpu=5'-cyclopropyl phosphonate-2'-O-methyluridine-3'-phosphate (see Table 11)
cPrpus=5'-cyclopropyl phosphonate-2'-O-methyluridine-3'-phosphorothioate (see Table 11)
(C6-SS—C6)=see Table 11
(C6-S)=see Table 11
(6-SS-6)=see Table 11
(NH2-C6)=see Table 11
(NH2-C6)s=see Table 11
(NH—C6)=see Table 11
(NH—C6)s=see Table 11
L6=see Table 11
LP-371-a=see Table 11
LP-379-a=see Table 11
LP-371-p=see Table 11
LP-379-p=see Table 11
(NAG37)=see Table 11
(NAG37)s=see Table 11

As the person of ordinary skill in the art would readily understand, unless otherwise indicated by the sequence (such as, for example, by a phosphorothioate linkage "s" or phosphorodithioate linkage "ss"), when present in an oligonucleotide, the nucleotide monomers are mutually linked by 5'-3'-phosphodiester bonds. As the person of ordinary skill in the art would clearly understand, the inclusion of a phosphorothioate or phosphorodithioate linkage as shown in the modified nucleotide sequences disclosed herein replaces the phosphodiester linkage typically present in oligonucleotides. Further, the person of ordinary skill in the art would readily understand that the terminal nucleotide at the 3' end of a given oligonucleotide sequence would typically have a hydroxyl (—OH) group at the respective 3' position of the given monomer instead of a phosphate moiety ex vivo. Additionally, for the embodiments disclosed herein, when viewing the respective strand 5'→3', the inverted abasic residues are inserted such that the 3' position of the deoxyribose is linked at the 3' end of the preceding monomer on the respective strand (see, e.g., Table 11). Moreover, as the person of ordinary skill would readily understand and appreciate, while the phosphorothioate chemical structures depicted herein typically show the anion on the sulfur atom, the inventions disclosed herein encompass all phosphorothioate tautomers (e.g., where the sulfur atom has a double-bond and the anion is on an oxygen atom). Unless expressly indicated otherwise herein, such understandings of the person of ordinary skill in the art are used when describing the ALK7 RNAi agents and compositions of ALK7 RNAi agents disclosed herein.

Certain examples of PK/PD modulators and linking groups used with the ALK7 RNAi agents disclosed herein are included in the chemical structures provided below in Table 11. Each sense strand and/or antisense strand can have any PK/PD modulators or linking groups listed herein, as well as other targeting groups, PK/PD modulators, linking groups, conjugated to the 5' and/or 3' end of the sequence.

TABLE 3

ALK7 RNAi Agent Antisense Strand Sequences

| AS Strand ID | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| CA005127 | cPrpusAfsugauAfgaauCfgUfgCfuucasc | 262 | UAUGAUAGAAUCGUGCUUCAC | 551 |
| CA005129 | cPrpusAfsggauUfcuggGfgUfaUfgucusc | 263 | UAGGAUUCUGGGGUAUGUCUC | 552 |
| CA005131 | cPrpusCfsgaauAfgaugUfcAfgCfucgcsu | 264 | UCGAAUAGAUGUCAGCUCGCU | 553 |
| CA005139 | cPrpasAfsgacaUfacacAfcUfuCfagucsc | 265 | AAGACAUACACACUUCAGUCC | 554 |
| CA005141 | cPrpusCfsaacaUfgcucCfuUfcUfguuusg | 266 | UCAACAUGCUCCUUCUGUUUG | 555 |
| CA005143 | cPrpusUfsccauUfgguuAfgCfaUfgacusg | 267 | UUCCAUUGGUUAGCAUGACUG | 556 |
| CA005145 | cPrpusUfsuggaAfcuauGfaCfaGfaagasc | 268 | UUUGGAACUAUGACAGAAGAC | 557 |
| CA005147 | cPrpasUfsuguuGfgaacUfaUfgAfcagasc | 269 | AUUGUUGGAACUAUGACAGAC | 558 |
| CA005149 | cPrpusCfsaugaUfauucAfgAfuAfccagsc | 270 | UCAUGAUAUUCAGAUACCAGC | 559 |
| CA005151 | cPrpusCfsauauAfaggaGfcCfcUfguucsa | 271 | UCAUAUAAGGAGCCCUGUUCA | 560 |
| CA005153 | cPrpasUfsaugaAfggugUfgCfcAfgaccsa | 272 | AUAUGAAGGUGUGCCAGACCA | 561 |
| CA005155 | cPrpusCfsauauGfaaggUfgUfgCfcagasc | 273 | UCAUAUGAAGGUGUGCCAGAC | 562 |
| CA005157 | cPrpusUfsccauAfugaaGfgUfgUfgccasg | 274 | UUCCAUAUGAAGGUGUGCCAG | 563 |
| CA005159 | cPrpasAfsuagcAfgguuUfaCfcUfugugsu | 275 | AAUAGCAGGUUUACCUUGUGU | 564 |
| CA005161 | cPrpasGfscaauAfgcagGfuUfuAfccuusg | 276 | AGCAAUAGCAGGUUUACCUUG | 565 |

TABLE 3-continued

| ALK7 RNAi Agent Antisense Strand Sequences | | | | |
|---|---|---|---|---|
| AS Strand ID | Modified Antisense Strand (5'→3') | SEQ ID NO. | Underlying Base Sequence (5'→3') (Shown as an Unmodified Nucleotide Sequence) | SEQ ID NO. |
| CA005163 | cPrpusCfsuaagUfccgcUfaUfgGfcacasa | 277 | UCUAAGUCCGCUAUGGCACAA | 566 |
| CA005165 | cPrpasUfsugaaUfcaugCfuUfcAfcagcsc | 278 | AUUGAAUCAUGCUUCACAGCC | 567 |
| CA005167 | cPrpusAfsuugaAfucauGfcUfuCfacagsc | 279 | UAUUGAAUCAUGCUUCACAGC | 568 |
| CA005169 | cPrpusUfscgauAfguguUfcAfgUfauugsc | 280 | UUCGAUAGUGUUCAGUAUUGC | 569 |
| CA005171 | cPrpusGfsauucUfgaggUfaUfgUfcgausc | 281 | UGAUUCUGAGGUAUGUCGAUC | 570 |
| CA005173 | cPrpusGfsuaucAfucaaGfcAfuUfucagsg | 282 | UGUAUCAUCAAGCAUUUCAGG | 571 |
| CA005175 | cPrpusAfsuuguAfucauCfaAfgCfauuusc | 283 | UAUUGUAUCAUCAAGCAUUUC | 572 |
| CA005177 | cPrpusAfsgaauAfgaugUfcAfgCfucgusu | 284 | UAGAAUAGAUGUCAGCUCGUU | 573 |
| CA005179 | cPrpusAfsguaaAfccagAfcCfaAfcagasc | 285 | UAGUAAACCAGACCAACAGAC | 574 |
| CA005181 | cPrpusCfsaauuGfguacUfcCfuCfaacasc | 286 | UCAAUUGGUACUCCUCAACAC | 575 |
| CA005183 | cPrpusCfsucuaUfcgagGfgAfuCfugaasg | 287 | UCUCUAUCGAGGGAUCUGAAG | 576 |
| CA005185 | cPrpasUfsuuccUfcuauCfgAfgGfgaucsu | 288 | AUUUCCUCUAUCGAGGGAUCU | 577 |
| CA005187 | cPrpusGfsauacUfugguCfgAfaAfcuucsu | 289 | UGAUACUUGGUCGAAACUUCU | 578 |
| CA005189 | cPrpusCfsuuaaUfacgaAfgAfgCfaguusc | 290 | UCUUAAUACGAAGAGCAGUUC | 579 |
| CA006102 | cPrpusAfsugauagaauCfgUfgCfuucasc | 291 | UAUGAUAGAAUCGUGCUUCAC | 551 |
| CA007125 | cPrpusUfsuggaAfcuauGfaCfaGfaagsasc | 292 | UUUGGAACUAUGACAGAAGAC | 557 |
| CA007130 | cPrpusUfsuggaacuauGfaCfagaagasc | 293 | UUUGGAACUAUGACAGAAGAC | 557 |
| CA007131 | cPrpusUfsUfggaacuauGfaCfaGfaagasc | 294 | UUUGGAACUAUGACAGAAGAC | 557 |
| CA007132 | cPrpusUfsuGfgaacuauGfaCfaGfaagasc | 295 | UUUGGAACUAUGACAGAAGAC | 557 |
| CA007133 | cPrpusUfsuggAfacuauGfaCfaGfaagasc | 296 | UUUGGAACUAUGACAGAAGAC | 557 |
| CA007134 | cPrpusUfsuggAfaCfuAfuGfaCfaGfaagasc | 297 | UUUGGAACUAUGACAGAAGAC | 557 |
| CA007135 | cPrpasUfsuguuGfgaacUfaUfgAfcagsasc | 298 | AUUGUUGGAACUAUGACAGAC | 558 |
| CA007137 | cPrpusUfsuguuGfgaacUfaUfgAfcagasc | 299 | UUUGUUGGAACUAUGACAGAC | 580 |
| CA007142 | cPrpasUfsuguuggaacUfaUfgacagasc | 300 | AUUGUUGGAACUAUGACAGAC | 558 |
| CA007143 | cPrpasUfsUfguuggaacUfaUfgAfcagasc | 301 | AUUGUUGGAACUAUGACAGAC | 558 |
| CA007144 | cPrpasUfsuGfuuggaacUfaUfgAfcagasc | 302 | AUUGUUGGAACUAUGACAGAC | 558 |
| CA007145 | cPrpasUfsuguUfggaacUfaUfgAfcagasc | 303 | AUUGUUGGAACUAUGACAGAC | 558 |
| CA007147 | cPrpusCfsaugaUfauucAfgAfuAfccasgsc | 304 | UCAUGAUAUUCAGAUACCAGC | 559 |
| CA007152 | cPrpusCfsaugauauucAfgAfuaccagsc | 305 | UCAUGAUAUUCAGAUACCAGC | 559 |
| CA007153 | cPrpusCfsAfugauauucAfgAfuAfccagsc | 306 | UCAUGAUAUUCAGAUACCAGC | 559 |
| CA007154 | cPrpusCfsaUfgauauucAfgAfuAfccagsc | 307 | UCAUGAUAUUCAGAUACCAGC | 559 |
| CA007155 | cPrpusCfsaugAfuauucAfgAfuAfccagsc | 308 | UCAUGAUAUUCAGAUACCAGC | 559 |
| CA007156 | cPrpusCfsaugAfuAfuUfcAfgAfuAfccagsc | 309 | UCAUGAUAUUCAGAUACCAGC | 559 |
| CA007379 | cPrpisUfsuguuGfgaacUfaUfgAfcagasc | 310 | IUUGUUGGAACUAUGACAGAC | 581 |
| CA007380 | cPrpisUfsuguuGfgaacUfaUfgAfcagasc | 311 | IUUGUUGGAACUAUGACAGAC | 581 |
| CA007563 | cPrpusUfscgauAfguguUfcAfgUfauusgsc | 312 | UUCGAUAGUGUUCAGUAUUGC | 569 |
| CA007568 | cPrpusUfscgauaguguUfcAfguauugsc | 313 | UUCGAUAGUGUUCAGUAUUGC | 569 |

TABLE 3-continued

| AS Strand ID | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| ALK7 RNAi Agent Antisense Strand Sequences | | | | |
| CA007569 | cPrpusUfsCfgauaguguUfcAfgUfauugsc | 314 | UUCGAUAGUGUUCAGUAUUGC | 569 |
| CA007570 | cPrpusUfscGfauaguguUfcAfgUfauugsc | 315 | UUCGAUAGUGUUCAGUAUUGC | 569 |
| CA007571 | cPrpusUfscgaUfaguguUfcAfgUfauugsc | 316 | UUCGAUAGUGUUCAGUAUUGC | 569 |
| CA007572 | cPrpusUfscgaUfaGfuGfuUfcAfgUfauugsc | 317 | UUCGAUAGUGUUCAGUAUUGC | 569 |
| CA007573 | cPrpusUfscGfaUfaGfuGfuUfcAfgUfauugsc | 318 | UUCGAUAGUGUUCAGUAUUGC | 569 |
| CA007574 | cPrpusGfsuaucAfucaaGfcAfuUfucasgsg | 319 | UGUAUCAUCAAGCAUUUCAGG | 571 |
| CA007579 | cPrpusGfsuaucaucaaGfcAfuuucagsg | 320 | UGUAUCAUCAAGCAUUUCAGG | 571 |
| CA007580 | cPrpusGfsUfaucaucaaGfcAfuUfucagsg | 321 | UGUAUCAUCAAGCAUUUCAGG | 571 |
| CA007581 | cPrpusGfsuAfucaucaaGfcAfuUfucagsg | 322 | UGUAUCAUCAAGCAUUUCAGG | 571 |
| CA007582 | cPrpusGfsuauCfaucaaGfcAfuUfucagsg | 323 | UGUAUCAUCAAGCAUUUCAGG | 571 |
| CA007583 | cPrpusGfsuauCfaUfcAfaGfcAfuUfucagsg | 324 | UGUAUCAUCAAGCAUUUCAGG | 571 |
| CA007584 | cPrpusGfsuAfuCfaUfcAfaGfcAfuUfucagsg | 325 | UGUAUCAUCAAGCAUUUCAGG | 571 |
| CA007586 | cPrpusAfsuuguAfucauCfaAfgCfauusus c | 326 | UAUUGUAUCAUCAAGCAUUUC | 572 |
| CA007591 | cPrpusAfsuuguaucauCfaAfgcauuusc | 327 | UAUUGUAUCAUCAAGCAUUUC | 572 |
| CA007592 | cPrpusAfsUfuguaucauCfaAfgCfauuusc | 328 | UAUUGUAUCAUCAAGCAUUUC | 572 |
| CA007593 | cPrpusAfsuUfguaucauCfaAfgCfauuusc | 329 | UAUUGUAUCAUCAAGCAUUUC | 572 |
| CA007594 | cPrpusAfsuugUfaucauCfaAfgCfauuusc | 330 | UAUUGUAUCAUCAAGCAUUUC | 572 |
| CA007595 | cPrpusAfsuugUfaUfcAfuCfaAfgCfauuusc | 331 | UAUUGUAUCAUCAAGCAUUUC | 572 |
| CA007596 | cPrpusAfsuUfgUfaUfcAfuCfaAfgCfauuusc | 332 | UAUUGUAUCAUCAAGCAUUUC | 572 |
| CA008042 | cPrpusGfsuaUfcaucaaGfcAfuUfucagsg | 333 | UGUAUCAUCAAGCAUUUCAGG | 571 |
| CA008047 | cPrpusGfsuaUfcaucaaGfcAfuUfucagssg | 334 | UGUAUCAUCAAGCAUUUCAGG | 571 |
| CA008050 | cPrpisUfsugUfuggaacUfaUfgAfcagasc | 335 | IUUGUUGGAACUAUGACAGAC | 581 |
| CA008052 | cPrpusCfsauGfauauucAfgAfuAfccagsc | 336 | UCAUGAUAUUCAGAUACCAGC | 559 |
| CA008053 | cPrpusCfsauGfauauucAfgAfuAfccagssc | 337 | UCAUGAUAUUCAGAUACCAGC | 559 |
| CA008054 | cPrpusUfscgAfuaguguUfcAfgUfauugsc | 338 | UUCGAUAGUGUUCAGUAUUGC | 569 |
| CA008055 | cPrpusUfscgAfuaguguUfcAfgUfauugssc | 339 | UUCGAUAGUGUUCAGUAUUGC | 569 |
| CA008087 | cPrpisUfsugUfuggaacUfaUfgAfcagassc | 340 | IUUGUUGGAACUAUGACAGAC | 581 |
| CA008542 | cPrpusUfsuggaAfcuauGfaUfaGfaagasc | 341 | UUUGGAACUAUGAUAGAAGAC | 582 |
| CA008544 | cPrpusUfsuggaAfcuauGfaCfaGfaggasc | 342 | UUUGGAACUAUGACAGAGGAC | 583 |
| CA008546 | cPrpusUfsuggaAfcuauGfaCfaGfaaggsc | 343 | UUUGGAACUAUGACAGAAGGC | 584 |
| CA008547 | cPrpusUfsuggaAfcuauGfaUfaGfaggasc | 344 | UUUGGAACUAUGAUAGAGGAC | 585 |
| CA008548 | cPrpusUfsuggaAfcuauGfaUfaGfaaggsc | 345 | UUUGGAACUAUGAUAGAAGGC | 586 |
| CA008550 | cPrpusUfsuggaAfcuauGfaCfaGfggg | 346 | UUUGGAACUAUGACAGGGG | 587 |
| CA008551 | cPrpusUfsuggaAfcuauGfaUfaGfggg | 347 | UUUGGAACUAUGAUAGGGG | 588 |
| CA008553 | cPrpusUfsuGfuuggaacUfaUfgAfcagasc | 348 | UUUGUUGGAACUAUGACAGAC | 580 |
| CA008554 | cPrpisUfsuGfuuggaacUfaUfgAfcagasc | 349 | IUUGUUGGAACUAUGACAGAC | 581 |
| CA008555 | cPrpisUfsuGfuuggaacUfaUfgAfcagassc | 350 | IUUGUUGGAACUAUGACAGAC | 581 |

TABLE 3-continued

ALK7 RNAi Agent Antisense Strand Sequences

| AS Strand ID | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| CA008556 | cPrpisUfsuguuGfgaacUfaUfgAfcagassc | 351 | IUUGUUGGAACUAUGACAGAC | 581 |
| CA009908 | cPrpusUfsuggaAfcuauGfaCfaGfaagassc | 352 | UUUGGAACUAUGACAGAAGAC | 557 |
| CA009909 | cPrpusUfsugggAfcuauGfaCfaGfaagasc | 353 | UUUGGGACUAUGACAGAAGAC | 589 |
| CA009910 | cPrpusUfsuggG$_{UNA}$AfcuauGfaCfaGfaagasc | 354 | UUUGGGACUAUGACAGAAGAC | 589 |
| CA009911 | cPrpusUfsuggG$_{UNA}$AfcuauGfaCfaGfaggasc | 355 | UUUGGGACUAUGACAGAGGAC | 590 |
| CA009912 | cPrpusUfsuggaGfcuauGfaCfaGfaagasc | 356 | UUUGGAGCUAUGACAGAAGAC | 591 |
| CA009913 | cPrpusUfsuggaG$_{UNA}$cuauGfaCfaGfaggasc | 357 | UUUGGAGCUAUGACAGAGGAC | 592 |
| CA009914 | cPrpusUfsuigaAfcuauGfaCfaGfaagasc | 358 | UUUIGAACUAUGACAGAAGAC | 593 |
| CA009915 | cPrpusUfsugiaAfcuauGfaCfaGfaagasc | 359 | UUUGIAACUAUGACAGAAGAC | 594 |

I = inosine (hypoxanthine nucleobase) nucleotide

TABLE 4

ALK7 Agent Sense Strand Sequences (Shown Without Linkers, Conjugates, Capping Moieties, or Terminal dT)

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS005138-NL | ggacugaaGfUfGfuguaugucuu | 360 | GGACUGAAGUGUGUAUGUCUU | 595 |
| CS005140-NL | caaacagaAfGfGfagcauguuga | 361 | CAAACAGAAGGAGCAUGUUGA | 596 |
| CS005142-NL | cagucaugCfUfAfaccaauggaa | 362 | CAGUCAUGCUAACCAAUGGAA | 597 |
| CS005144-NL | gucuucugUfCfAfuaguuccaaa | 363 | GUCUUCUGUCAUAGUUCCAAA | 598 |
| CS005146-NL | gucugucaUfAfGfuuccaacaau | 364 | GUCUGUCAUAGUUCCAACAAU | 599 |
| CS005148-NL | gcugguauCfUfGfaauaucauga | 365 | GCUGGUAUCUGAAUAUCAUGA | 600 |
| CS005150-NL | ugaacaggGfCfUfccuuauauga | 366 | UGAACAGGGCUCCUUAUAUGA | 601 |
| CS005152-NL | uggucuggCfAfCfaccuucauau | 367 | UGGUCUGGCACACCUUCAUAU | 602 |
| CS005154-NL | gucuggcaCfAfCfcuucauauga | 368 | GUCUGGCACACCUUCAUAUGA | 603 |
| CS005156-NL | cuggcacaCfCfUfucauauggaa | 369 | CUGGCACACCUUCAUAUGGAA | 604 |
| CS005158-NL | acacaaggUfAfAfaccugcuauu | 370 | ACACAAGGUAAACCUGCUAUU | 605 |
| CS005160-NL | caagguaaAfCfCfugcuauugcu | 371 | CAAGGUAAACCUGCUAUUGCU | 606 |
| CS005162-NL | uugugccaUfAfGfcggacuuaga | 372 | UUGUGCCAUAGCGGACUUAGA | 607 |
| CS005164-NL | ggcugugaAfGfCfaugauucaau | 373 | GGCUGUGAAGCAUGAUUCAAU | 608 |
| CS005166-NL | gcugugaaGfCfAfugauucaaua | 374 | GCUGUGAAGCAUGAUUCAAUA | 609 |
| CS005168-NL | gcaauacuGfAfAfcacuaucgaa | 375 | GCAAUACUGAACACUAUCGAA | 610 |
| CS005170-NL | gaucgacaUfAfCfcucagaauca | 376 | GAUCGACAUACCUCAGAAUCA | 611 |
| CS005172-NL | ccugaaauGfCfUfugaugauaca | 377 | CCUGAAAUGCUUGAUGAUACA | 612 |
| CS005174-NL | ga_2NaaugcuUfGfAfugauacaa_2Nua | 378 | G(A$^{2N}$)AAUGCUUGAUGAUACA(A$^{2N}$)UA | 613 |
| CS005176-NL | aacgagcuGfAfCfaucuauucua | 379 | AACGAGCUGACAUCUAUUCUA | 614 |
| CS005178-NL | gucuguugGfUfCfugguuuacua | 380 | GUCUGUUGGUCUGGUUUACUA | 615 |
| CS005180-NL | guguugagGfAfGfuaccaauuga | 381 | GUGUUGAGGAGUACCAAUUGA | 616 |

TABLE 4-continued

ALK7 Agent Sense Strand Sequences (Shown Without Linkers, Conjugates, Capping Moieties, or Terminal dT)

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS005182-NL | cuucagauCfCfCfucgauagaga | 382 | CUUCAGAUCCCUCGAUAGAGA | 617 |
| CS005184-NL | agaucccuCfGfAfuagaggaaau | 383 | AGAUCCCUCGAUAGAGGAAAU | 618 |
| CS005186-NL | a_2NgaaguuuCfGfAfccaaguauca | 384 | ($A^{2N}$)GAAGUUUCGACCAAGUAUCA | 619 |
| CS005188-NL | gaacugcuCfUfUfcguauuaaga | 385 | GAACUGCUCUUCGUAUUAAGA | 620 |
| CS005209-NL | ggacugaaGfUfGfuguaugucuu | 386 | GGACUGAAGUGUGUAUGUCUU | 595 |
| CS005210-NL | caaacagaAfGfGfagcauguuga | 387 | CAAACAGAAGGAGCAUGUUGA | 596 |
| CS005211-NL | cagucaugCfUfAfaccaauggaa | 388 | CAGUCAUGCUAACCAAUGGAA | 597 |
| CS005212-NL | gucuucugUfCfAfuaguuccaaa | 389 | GUCUUCUGUCAUAGUUCCAAA | 598 |
| CS005213-NL | gucugucaUfAfGfuuccaacaau | 390 | GUCUGUCAUAGUUCCAACAAU | 599 |
| CS005214-NL | gcugguauCfUfGfaauaucauga | 391 | GCUGGUAUCUGAAUAUCAUGA | 600 |
| CS005215-NL | ugaacaggGfCfUfccuuauauga | 392 | UGAACAGGGCUCCUUAUAUGA | 601 |
| CS005216-NL | uggucuggCfAfCfaccuucauau | 393 | UGGUCUGGCACACCUUCAUAU | 602 |
| CS005217-NL | gucuggcaCfAfCfcuucauauga | 394 | GUCUGGCACACCUUCAUAUGA | 603 |
| CS005218-NL | cuggcacaCfCfUfucauauggaa | 395 | CUGGCACACCUUCAUAUGGAA | 604 |
| CS005219-NL | acacaaggUfAfAfaccugcuauu | 396 | ACACAAGGUAAACCUGCUAUU | 605 |
| CS005220-NL | caagguaaAfCfCfugcuauugcu | 397 | CAAGGUAAACCUGCUAUUGCU | 606 |
| CS005221-NL | uugugccaUfAfGfcggacuuaga | 398 | UUGUGCCAUAGCGGACUUAGA | 607 |
| CS005222-NL | ggcugugaAfGfCfaugauucaau | 399 | GGCUGUGAAGCAUGAUUCAAU | 608 |
| CS005223-NL | gcugugaaGfCfAfugauucaaua | 400 | GCUGUGAAGCAUGAUUCAAUA | 609 |
| CS005224-NL | gcaauacuGfAfAfcacuaucgaa | 401 | GCAAUACUGAACACUAUCGAA | 610 |
| CS005225-NL | gaucgacaUfAfCfcucagaauca | 402 | GAUCGACAUACCUCAGAAUCA | 611 |
| CS005226-NL | ccugaaauGfCfUfugaugauaca | 403 | CCUGAAAUGCUUGAUGAUACA | 612 |
| CS005227-NL | ga_2NaaugcuUfGfAfugauacaa_2Nua | 404 | G($A^{2N}$)AAUGCUUGAUGAUACA($A^{2N}$)UA | 613 |
| CS005228-NL | aacgagcuGfAfCfaucuauucua | 405 | AACGAGCUGACAUCUAUUCUA | 614 |
| CS005229-NL | gucuguugGfUfCfugguuuacua | 406 | GUCUGUUGGUCUGGUUUACUA | 615 |
| CS005230-NL | guguugagGfAfGfuaccaauuga | 407 | GUGUUGAGGAGUACCAAUUGA | 616 |
| CS005231-NL | cuucagauCfCfCfucgauagaga | 408 | CUUCAGAUCCCUCGAUAGAGA | 617 |
| CS005232-NL | agaucccuCfGfAfuagaggaaau | 409 | AGAUCCCUCGAUAGAGGAAAU | 618 |
| CS005233-NL | a_2NgaaguuuCfGfAfccaaguauca | 410 | ($A^{2N}$)GAAGUUUCGACCAAGUAUCA | 619 |
| CS005234-NL | gaacugcuCfUfUfcguauuaaga | 411 | GAACUGCUCUUCGUAUUAAGA | 620 |
| CS007126-NL | gucuucugUfcAfuAfguuccaaa | 412 | GUCUUCUGUCAUAGUUCCAAA | 598 |
| CS007127-NL | gucuucugUfCfaUfaguuccaaa | 413 | GUCUUCUGUCAUAGUUCCAAA | 598 |
| CS007128-NL | gucuucUfguCfAfuaguuccaaa | 414 | GUCUUCUGUCAUAGUUCCAAA | 598 |
| CS007129-NL | gucuucUfgUfcAfuaguuccaaa | 415 | GUCUUCUGUCAUAGUUCCAAA | 598 |
| CS007136-NL | gucugucaUfAfGfuuccaacaaa | 416 | GUCUGUCAUAGUUCCAACAAA | 621 |
| CS007138-NL | gucugucaUfaGfuUfccaacaau | 417 | GUCUGUCAUAGUUCCAACAAU | 599 |

TABLE 4-continued

ALK7 Agent Sense Strand Sequences (Shown Without Linkers, Conjugates, Capping Moieties, or Terminal dT)

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS007139-NL | gucugucaUfAfgUfuccaacaau | 418 | GUCUGUCAUAGUUCCAACAAU | 599 |
| CS007140-NL | gucuguCfauAfGfuuccaacaau | 419 | GUCUGUCAUAGUUCCAACAAU | 599 |
| CS007141-NL | gucuguCfaUfaGfuuccaacaau | 420 | GUCUGUCAUAGUUCCAACAAU | 599 |
| CS007148-NL | gcugguauCfuGfaAfuaucauga | 421 | GCUGGUAUCUGAAUAUCAUGA | 600 |
| CS007149-NL | gcugguauCfUfgAfauaucauga | 422 | GCUGGUAUCUGAAUAUCAUGA | 600 |
| CS007150-NL | gcugguAfucUfGfaauaucauga | 423 | GCUGGUAUCUGAAUAUCAUGA | 600 |
| CS007151-NL | gcugguAfuCfuGfaauaucauga | 424 | GCUGGUAUCUGAAUAUCAUGA | 600 |
| CS007564-NL | gcaauacuGfaAfcAfcuaucgaa | 425 | GCAAUACUGAACACUAUCGAA | 610 |
| CS007565-NL | gcaauacuGfAfaCfacuaucgaa | 426 | GCAAUACUGAACACUAUCGAA | 610 |
| CS007566-NL | gcaauaCfugAfAfcacuaucgaa | 427 | GCAAUACUGAACACUAUCGAA | 610 |
| CS007567-NL | gcaauaCfuGfaAfcacuaucgaa | 428 | GCAAUACUGAACACUAUCGAA | 610 |
| CS007578-NL | ccugaaAfuGfcUfugaugauaca | 429 | CCUGAAAUGCUUGAUGAUACA | 612 |
| CS007711-NL | gaaaugcuUfGfAfugauacaaua | 430 | GAAAUGCUUGAUGAUACAAUA | 622 |
| CS007712-NL | ga_2NaaugcuUfgAfuGfauacaa_2Nua | 431 | G($A^{2N}$)AAUGCUUGAUGAUACA($A^{2N}$)UA | 613 |
| CS007713-NL | ga_2NaaugcuUfGfaUfgauacaa_2Nua | 432 | G($A^{2N}$)AAUGCUUGAUGAUACA($A^{2N}$)UA | 613 |
| CS007714-NL | ga_2NaaugCfuuGfAfugauacaa_2Nua | 433 | G($A^{2N}$)AAUGCUUGAUGAUACA($A^{2N}$)UA | 613 |
| CS007715-NL | ga_2NaaugCfuUfgAfugauacaa_2Nua | 434 | G($A^{2N}$)AAUGCUUGAUGAUACA($A^{2N}$)UA | 613 |
| CS007716-NL | ccugaaauGfcUfuGfaugauaca | 435 | CCUGAAAUGCUUGAUGAUACA | 612 |
| CS007717-NL | ccugaaauGfCfuUfgaugauaca | 436 | CCUGAAAUGCUUGAUGAUACA | 612 |
| CS007718-NL | ccugaaAfugCfUfugaugauaca | 437 | CCUGAAAUGCUUGAUGAUACA | 612 |
| CS007719-NL | ccugaaAfuGfcUfugaugauaca | 438 | CCUGAAAUGCUUGAUGAUACA | 612 |
| CS008543-NL | guccucugUfcAfuAfguuccaaa | 439 | GUCCUCUGUCAUAGUUCCAAA | 623 |
| CS008545-NL | gccuucugUfcAfuAfguuccaaa | 440 | GCCUUCUGUCAUAGUUCCAAA | 624 |
| CS008549-NL | ccccugUfcAfuAfguuccaaa | 441 | CCCCUGUCAUAGUUCCAAA | 625 |
| CS008552-NL | gucugucaUfaGfuUfccaacaaa | 442 | GUCUGUCAUAGUUCCAACAAA | 621 |
| CS011689-NL | ccugaaAfuGfcUfugaugauaca | 443 | CCUGAAAUGCUUGAUGAUACA | 612 |
| CS011691-NL | ccugaaAfuGfcUfugaugauaca | 444 | CCUGAAAUGCUUGAUGAUACA | 612 |

I = inosine (hypoxanthine nucleobase) nucleotide
($A^{2N}$) = 2-aminoadenosine nucleotide

TABLE 5

ALK7 Agent Sense Strand Sequences (Shown With (NH2-C6) Linker, (NAG37)s ligand, (invAb) end cap, or terminal dT (see Table 11 for structure information.))

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS005138 | (NH2-C6)s(invAb)sggacugaaGfUfGfuguaugucuus(invAb)-(C6-SS)-MeC5-dT | 445 | GGACUGAAGUGUGUAUGUCUUT | 626 |

TABLE 5-continued

ALK7 Agent Sense Strand Sequences (Shown With (NH2-C6) Linker, (NAG37)s ligand, (invAb) end cap, or terminal dT (see Table 11 for structure information.))

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS005140 | (NH2-C6)s(invAb)scaaacagaAfGfGfagcauguugas(invAb)-(C6-SS)-MeC5-dT | 446 | CAAACAGAAGGAGCAUGUUGAT | 627 |
| CS005142 | (NH2-C6)s(invAb)scagucaugCfUfAfaccaauggaas(invAb)-(C6-SS)-MeC5-dT | 447 | CAGUCAUGCUAACCAAUGGAAT | 628 |
| CS005144 | (NH2-C6)s(invAb)sgucuucugUfCfAfuaguuccaaas(invAb)-(C6-SS)-MeC5-dT | 448 | GUCUUCUGUCAUAGUUCCAAAT | 629 |
| CS005146 | (NH2-C6)s(invAb)sgucugucaUfAfGfuuccaacaaus(invAb)-(C6-SS)-MeC5-dT | 449 | GUCUGUCAUAGUUCCAACAAUT | 630 |
| CS005148 | (NH2-C6)s(invAb)sgcugguauCfUfGfaauaucaugas(invAb)-(C6-SS)-MeC5-dT | 450 | GCUGGUAUCUGAAUAUCAUGAT | 631 |
| CS005150 | (NH2-C6)s(invAb)sugaacaggGfCfUfccuuauaugas(invAb)-(C6-SS)-MeC5-dT | 451 | UGAACAGGGCUCCUUAUAUGAT | 632 |
| CS005152 | (NH2-C6)s(invAb)suggucuggCfAfCfaccuucauaus(invAb)-(C6-SS)-MeC5-dT | 452 | UGGUCUGGCACACCUUCAUAUT | 633 |
| CS005154 | (NH2-C6)s(invAb)sgucuggcaCfAfCfcuucauaugas(invAb)-(C6-SS)-MeC5-dT | 453 | GUCUGGCACACCUUCAUAUGAT | 634 |
| CS005156 | (NH2-C6)s(invAb)scuggcacaCfCfUfucauauggaas(invAb)-(C6-SS)-MeC5-dT | 454 | CUGGCACACCUUCAUAUGGAAT | 635 |
| CS005158 | (NH2-C6)s(invAb)sacacaaggUfAfAfaccugcuauus(invAb)-(C6-SS)-MeC5-dT | 455 | ACACAAGGUAAACCUGCUAUUT | 636 |
| CS005160 | (NH2-C6)s(invAb)scaagguaaAfCfCfugcuauugcus(invAb)-(C6-SS)-MeC5-dT | 456 | CAAGGUAAACCUGCUAUUGCUT | 637 |
| CS005162 | (NH2-C6)s(invAb)suugugccaUfAfGfcggacuuagas(invAb)-(C6-SS)-MeC5-dT | 457 | UUGUGCCAUAGCGGACUUAGAT | 638 |
| CS005164 | (NH2-C6)s(invAb)sggcugugaAfGfCfaugauucaaus(invAb)-(C6-SS)-MeC5-dT | 458 | GGCUGUGAAGCAUGAUUCAAUT | 639 |
| CS005166 | (NH2-C6)s(invAb)sgcugugaaGfCfAfugauucaauas(invAb)-(C6-SS)-MeC5-dT | 459 | GCUGUGAAGCAUGAUUCAAUAT | 640 |
| CS005168 | (NH2-C6)s(invAb)sgcaauacuGfAfAfcacuaucgaas(invAb)-(C6-SS)-MeC5-dT | 460 | GCAAUACUGAACACUAUCGAAT | 641 |
| CS005170 | (NH2-C6)s(invAb)sgaucgacaUfAfCfcucagaaucas(invAb)-(C6-SS)-MeC5-dT | 461 | GAUCGACAUACCUCAGAAUCAT | 642 |
| CS005172 | (NH2-C6)s(invAb)sccugaaauGfCfUfugaugauacas(invAb)-(C6-SS)-MeC5-dT | 462 | CCUGAAAUGCUUGAUGAUACAT | 643 |
| CS005174 | (NH2-C6)s(invAb)sga_2NaaugcuUfGfAfugauacaa_2Nuas(invAb)-(C6-SS)-MeC5-dT | 463 | G($A^{2N}$)AAUGCUUGAUGAUACA($A^{2N}$)UAT | 644 |
| CS005176 | (NH2-C6)s(invAb)saacgagcuGfAfCfaucuauucuas(invAb)-(C6-SS)-MeC5-dT | 464 | AACGAGCUGACAUCUAUUCUAT | 645 |
| CS005178 | (NH2-C6)s(invAb)sgucuguugGfUfCfugguuuacuas(invAb)-(C6-SS)-MeC5-dT | 465 | GUCUGUUGGUCUGGUUUACUAT | 646 |
| CS005180 | (NH2-C6)s(invAb)sguguugagGfAfGfuaccaauugas(invAb)-(C6-SS)-MeC5-dT | 466 | GUGUUGAGGAGUACCAAUUGAT | 647 |
| CS005182 | (NH2-C6)s(invAb)scuucagauCfCfCfucgauagagas(invAb)-(C6-SS)-MeC5-dT | 467 | CUUCAGAUCCCUCGAUAGAGAT | 648 |
| CS005184 | (NH2-C6)s(invAb)sagaucccuCfGfAfuagaggaaaus(invAb)-(C6-SS)-MeC5-dT | 468 | AGAUCCCUCGAUAGAGGAAAUT | 649 |
| CS005186 | (NH2-C6)s(invAb)sa_2NgaaguuuCfGfAfccaaguaucas(invAb)-(C6-SS)-MeC5-dT | 469 | ($A^{2N}$)GAAGUUUCGACCAAGUAUCAT | 650 |

TABLE 5-continued

ALK7 Agent Sense Strand Sequences (Shown With (NH2-C6) Linker, (NAG37)s ligand, (invAb) end cap, or terminal dT (see Table 11 for structure information.))

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS005188 | (NH2-C6)s(invAb)sgaacugcuCfUfUfcguauuaagas(invAb)-(C6-SS)-MeC5-dT | 470 | GAACUGCUCUUCGUAUUAAGAT | 651 |
| CS005209 | (NAG37)s(invAb)sggacugaaGfUfGfuguaugucuus(invAb) | 471 | GGACUGAAGUGUGUAUGUCUU | 595 |
| CS005210 | (NAG37)s(invAb)scaaacagaAfGfGfagcauguugas(invAb) | 472 | CAAACAGAAGGAGCAUGUUGA | 596 |
| CS005211 | (NAG37)s(invAb)scagucaugCfUfAfaccaauggaas(invAb) | 473 | CAGUCAUGCUAACCAAUGGAA | 597 |
| CS005212 | (NAG37)s(invAb)sgucuucugUfCfAfuaguuccaaas(invAb) | 474 | GUCUUCUGUCAUAGUUCCAAA | 598 |
| CS005213 | (NAG37)s(invAb)sgucugucaUfAfGfuuccaacaaus(invAb) | 475 | GUCUGUCAUAGUUCCAACAAU | 599 |
| CS005214 | (NAG37)s(invAb)sgcugguauCfUfGfaauaucaugas(invAb) | 476 | GCUGGUAUCUGAAUAUCAUGA | 600 |
| CS005215 | (NAG37)s(invAb)sugaacaggGfCfUfccuuauaugas(invAb) | 477 | UGAACAGGGCUCCUUAUAUGA | 601 |
| CS005216 | (NAG37)s(invAb)suggucuggCfAfCfaccuucauaus(invAb) | 478 | UGGUCUGGCACACCUUCAUAU | 602 |
| CS005217 | (NAG37)s(invAb)sgucuggcaCfAfCfcuucauaugas(invAb) | 479 | GUCUGGCACACCUUCAUAUGA | 603 |
| CS005218 | (NAG37)s(invAb)scuggcacaCfCfUfucauauggaas(invAb) | 480 | CUGGCACACCUUCAUAUGGAA | 604 |
| CS005219 | (NAG37)s(invAb)sacacaaggUfAfAfaccugcuauus(invAb) | 481 | ACACAAGGUAAACCUGCUAUU | 605 |
| CS005220 | (NAG37)s(invAb)scaagguaaAfCfCfugcuauugcus(invAb) | 482 | CAAGGUAAACCUGCUAUUGCU | 606 |
| CS005221 | (NAG37)s(invAb)suugugccaUfAfGfcggacuuagas(invAb) | 483 | UUGUGCCAUAGCGGACUUAGA | 607 |
| CS005222 | (NAG37)s(invAb)sggcugugaAfGfCfaugauucaaus(invAb) | 484 | GGCUGUGAAGCAUGAUUCAAU | 608 |
| CS005223 | (NAG37)s(invAb)sgcugugaaGfCfAfugauucaauas(invAb) | 485 | GCUGUGAAGCAUGAUUCAAUA | 609 |
| CS005224 | (NAG37)s(invAb)sgcaauacuGfAfAfcacuaucgaas(invAb) | 486 | GCAAUACUGAACACUAUCGAA | 610 |
| CS005225 | (NAG37)s(invAb)sgaucgacaUfAfCfcucagaaucas(invAb) | 487 | GAUCGACAUACCUCAGAAUCA | 611 |
| CS005226 | (NAG37)s(invAb)sccugaaauGfCfUfugaugauacas(invAb) | 488 | CCUGAAAUGCUUGAUGAUACA | 612 |
| CS005227 | (NAG37)s(invAb)sga_2NaaugcuUfGfAfugauacaa_2Nuas(invAb) | 489 | G($A^{2N}$)AAUGCUUGAUGAUACA($A^{2N}$)UA | 613 |
| CS005228 | (NAG37)s(invAb)saacgagcuGfAfCfaucuauucuas(invAb) | 490 | AACGAGCUGACAUCUAUUCUA | 614 |
| CS005229 | (NAG37)s(invAb)sgucuguugGfUfCfugguuuacuas(invAb) | 491 | GUCUGUUGGUCUGGUUUACUA | 615 |
| CS005230 | (NAG37)s(invAb)sguguugagGfAfGfuaccaauugas(invAb) | 492 | GUGUUGAGGAGUACCAAUUGA | 616 |
| CS005231 | (NAG37)s(invAb)scuucagauCfCfCfucgauagagas(invAb) | 493 | CUUCAGAUCCCUCGAUAGAGA | 617 |
| CS005232 | (NAG37)s(invAb)sagaucccuCfGfAfuagaggaaaus(invAb) | 494 | AGAUCCCUCGAUAGAGGAAAU | 618 |
| CS005233 | (NAG37)s(invAb)sa_2NgaaguuuCfGfAfccaaguaucas(invAb) | 495 | ($A^{2N}$)GAAGUUUCGACCAAGUAUCA | 619 |
| CS005234 | (NAG37)s(invAb)sgaacugcuCfUfUfcguauuaagas(invAb) | 496 | GAACUGCUCUUCGUAUUAAGA | 620 |
| CS007126 | (NAG37)s(invAb)sgucuucugUfcAfuAfguuccaaas(invAb) | 497 | GUCUUCUGUCAUAGUUCCAAA | 598 |
| CS007127 | (NAG37)s(invAb)sgucuucugUfCfaUfaguuccaaas(invAb) | 498 | GUCUUCUGUCAUAGUUCCAAA | 598 |
| CS007128 | (NAG37)s(invAb)sgucuucUfguCfAfuaguuccaaas(invAb) | 499 | GUCUUCUGUCAUAGUUCCAAA | 598 |
| CS007129 | (NAG37)s(invAb)sgucuucUfgUfcAfuaguuccaaas(invAb) | 500 | GUCUUCUGUCAUAGUUCCAAA | 598 |
| CS007136 | (NAG37)s(invAb)sgucugucaUfAfGfuuccaacaaas(invAb) | 501 | GUCUGUCAUAGUUCCAACAAA | 621 |
| CS007138 | (NAG37)s(invAb)sgucugucaUfaGfuUfccaacaaus(invAb) | 502 | GUCUGUCAUAGUUCCAACAAU | 599 |
| CS007139 | (NAG37)s(invAb)sgucugucaUfAfgUfuccaacaaus(invAb) | 503 | GUCUGUCAUAGUUCCAACAAU | 599 |
| CS007140 | (NAG37)s(invAb)sgucuguCfauAfGfuuccaacaaus(invAb) | 504 | GUCUGUCAUAGUUCCAACAAU | 599 |

TABLE 5-continued

ALK7 Agent Sense Strand Sequences (Shown With (NH2-C6) Linker, (NAG37)s ligand, (invAb) end cap, or terminal dT (see Table 11 for structure information.))

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS007141 | (NAG37)s(invAb)sgucuguCfaUfaGfuuccaacaaus(invAb) | 505 | GUCUGUCAUAGUUCCAACAAU | 599 |
| CS007148 | (NAG37)s(invAb)sgcugguauCfuGfaAfuaucaugas(invAb) | 506 | GCUGGUAUCUGAAUAUCAUGA | 600 |
| CS007149 | (NAG37)s(invAb)sgcugguauCfUfgAfauaucaugas(invAb) | 507 | GCUGGUAUCUGAAUAUCAUGA | 600 |
| CS007150 | (NAG37)s(invAb)sgcugguAfucUfGfaauaucaugas(invAb) | 508 | GCUGGUAUCUGAAUAUCAUGA | 600 |
| CS007151 | (NAG37)s(invAb)sgcugguAfuCfuGfaauaucaugas(invAb) | 509 | GCUGGUAUCUGAAUAUCAUGA | 600 |
| CS007564 | (NAG37)s(invAb)sgcaauacuGfaAfcAfcuaucgaas(invAb) | 510 | GCAAUACUGAACACUAUCGAA | 610 |
| CS007565 | (NAG37)s(invAb)sgcaauacuGfAfaCfacuaucgaas(invAb) | 511 | GCAAUACUGAACACUAUCGAA | 610 |
| CS007566 | (NAG37)s(invAb)sgcaauaCfugAfAfcacuaucgaas(invAb) | 512 | GCAAUACUGAACACUAUCGAA | 610 |
| CS007567 | (NAG37)s(invAb)sgcaauaCfuGfaAfcacuaucgaas(invAb) | 513 | GCAAUACUGAACACUAUCGAA | 610 |
| CS007578 | (NAG37)s(invAb)sccugaaAfuGfcUfugaugauacas(invAb) | 514 | CCUGAAAUGCUUGAUGAUACA | 612 |
| CS007711 | (NH2-C6)s(invAb)sgaaaugcuUfGfAfugauacaauas(invAb)-(C6-SS)-MeC5-dT | 515 | GAAAUGCUUGAUGAUACAAUAT | 652 |
| CS007712 | (NH2-C6)s(invAb)sga_2NaaugcuUfgAfuGfauacaa_2Nuas(invAb)-(C6-SS)-MeC5-dT | 516 | G(A$^{2N}$)AAUGCUUGAUGAUACA(A$^{2N}$)UAT | 644 |
| CS007713 | (NH2-C6)s(invAb)sga_2NaaugcuUfGfaUfgauacaa_2Nuas(invAb)-(C6-SS)-MeC5-dT | 517 | G(A$^{2N}$)AAUGCUUGAUGAUACA(A$^{2N}$)UAT | 644 |
| CS007714 | (NH2-C6)s(invAb)sga_2NaaugCfuuGfAfugauacaa_2Nuas(invAb)-(C6-SS)-MeC5-dT | 518 | G(A$^{2N}$)AAUGCUUGAUGAUACA(A$^{2N}$)UAT | 644 |
| CS007715 | (NH2-C6)s(invAb)sga_2NaaugCfuUfgAfugauacaa_2Nuas(invAb)-(C6-SS)-MeC5-dT | 519 | G(A$^{2N}$)AAUGCUUGAUGAUACA(A$^{2N}$)UAT | 644 |
| CS007716 | (NH2-C6)s(invAb)sccugaaauGfcUfuGfaugauacas(invAb)-(C6-SS)-MeC5-dT | 520 | CCUGAAAUGCUUGAUGAUACAT | 643 |
| CS007717 | (NH2-C6)s(invAb)sccugaaauGfCfuUfgaugauacas(invAb)-(C6-SS)-MeC5-dT | 521 | CCUGAAAUGCUUGAUGAUACAT | 643 |
| CS007718 | (NH2-C6)s(invAb)sccugaaAfugCfUfugaugauacas(invAb)-(C6-SS)-MeC5-dT | 522 | CCUGAAAUGCUUGAUGAUACAT | 643 |
| CS007719 | (NH2-C6)s(invAb)sccugaaAfuGfcUfugaugauacas(invAb)-(C6-SS)-MeC5-dT | 523 | CCUGAAAUGCUUGAUGAUACAT | 643 |
| CS008543 | (NAG37)s(invAb)sguccucugUfcAfuAfguuccaaas(invAb) | 524 | GUCCUCUGUCAUAGUUCCAAA | 623 |
| CS008545 | (NAG37)s(invAb)sgccuucugUfcAfuAfguuccaaas(invAb) | 525 | GCCUUCUGUCAUAGUUCCAAA | 624 |
| CS008549 | (NAG37)s(invAb)sccccugUfcAfuAfguuccaaas(invAb) | 526 | CCCCUGUCAUAGUUCCAAA | 625 |
| CS008552 | (NAG37)s(invAb)sgucugucaUfaGfuUfccaacaaas(invAb) | 527 | GUCUGUCAUAGUUCCAACAAA | 621 |
| CS011689 | (NH2-C6)-L6-C6-sccugaaAfuGfcUfugaugauacas-(C6-SS)-MeC5-dT | 528 | CCUGAAAUGCUUGAUGAUACAT | 643 |
| CS011691 | (NH2-C6)sccugaaAfuGfcUfugaugauacas-(C6-SS)-MeC5-dT | 529 | CCUGAAAUGCUUGAUGAUACAT | 643 |

I = inosine (hypoxanthine nucleobase) nucleotide
(A$^{2N}$) = 2-aminoadenosine nucleotide

TABLE 6

ALK7 Agent Sense Strand Sequences (Shown with lipid moiety.) The structures of the lipid moieties are shown in Table 11.

| Strand ID | Modified Sense Strand (5'→3') | SEQ ID NO. | Corresponding Sense Strand ID Number Without Linker or Conjugate (See Table 4) |
|---|---|---|---|
| CS005429 | LP-379-a-L6-(NH-C6)s(invAb)sgugaagcaCfGfAfuucuaucauas(invAb)-(C6-S)-LP-371-a | 530 | |
| CS005430 | LP-379-a-L6-(NH-C6)s(invAb)sgagacauaCfCfCfcagaauccuas(invAb)-(C6-S)-LP-371-a | 531 | |
| CS005431 | LP-379-a-L6-(NH-C6)s(invAb)sagcgagcuGfAfCfaucuauucgas(invAb)-(C6-S)-LP-371-a | 532 | |
| CS007081 | LP-379-a-L6-(NH-C6)s(invAb)sga_2NaaugcuUfGfAfugauacaa_2Nuas(invAb)-(C6-S)-LP-371-a | 533 | CS005174-NL |
| CS007082 | LP-379-a-L6-(NH-C6)s(invAb)sccugaaauGfCfUfugaugauacas(invAb)-(C6-S)-LP-371-a | 534 | CS005172-NL |
| CS007437 | LP-379-a-L6-(NH-C6)s(invAb)sgucugucaUfAfGfuuccaacaaus(invAb)-(C6-S)-LP-371-a | 535 | CS005146-NL |
| CS007438 | LP-379-a-L6-(NH-C6)s(invAb)sgcugguauCfUfGfaauaucaugas(invAb)-(C6-S)-LP-371-a | 536 | CS005148-NL |
| CS007966 | LP-379-a-L6-(NH-C6)s(invAb)sccugaaauGfcUfuGfaugauacas(invAb)-(C6-S)-LP-371-a | 537 | CS007716-NL |
| CS007967 | LP-379-a-L6-(NH-C6)s(invAb)sccugaaauGfCfuUfgaugauacas(invAb)-(C6-S)-LP-371-a | 538 | CS007717-NL |
| CS007968 | LP-379-a-L6-(NH-C6)s(invAb)sccugaaAfugCfUfugaugauacas(invAb)-(C6-S)-LP-371-a | 539 | CS007718-NL |
| CS007969 | LP-379-a-L6-(NH-C6)s(invAb)sccugaaAfuGfcUfugaugauacas(invAb)-(C6-S)-LP-371-a | 540 | CS007719-NL |
| CS007970 | LP-379-a-L6-(NH-C6)s(invAb)sgaaaugcuUfGfAfugauacaauas(invAb)-(C6-S)-LP-371-a | 541 | CS007711-NL |
| CS007971 | LP-379-a-L6-(NH-C6)s(invAb)sga_2NaaugcuUfgAfuGfauacaa_2Nuas(invAb)-(C6-S)-LP-371-a | 542 | CS007712-NL |
| CS007972 | LP-379-a-L6-(NH-C6)s(invAb)sga_2NaaugcuUfGfaUfgauacaa_2Nuas(invAb)-(C6-S)-LP-371-a | 543 | CS007713-NL |
| CS007973 | LP-379-a-L6-(NH-C6)s(invAb)sga_2NaaugCfuuGfAfugauacaa_2Nuas(invAb)-(C6-S)-LP-371-a | 544 | CS007714-NL |
| CS007974 | LP-379-a-L6-(NH-C6)s(invAb)sga_2NaaugCfuUfgAfugauacaa_2Nuas(invAb)-(C6-S)-LP-371-a | 545 | CS007715-NL |
| CS009133 | LP-379-a-L6-(NH-C6)s(invAb)sgucuucugUfCfAfuaguuccaaas(invAb)-(C6-S)-LP-371-a | 546 | CS005144-NL |
| CS010070 | LP-379-a-L6-(NH-C6)s(invAb)sgucugucaUfAfGfuuccaacaaus(invAb)-(C6-SS)-MeC5-dT | 547 | CS005146-NL |
| CS011693 | LP-379-a-L6-(NH-C6)sccugaaAfuGfcUfugaugauacas-(C6-SS)-MeC5-dT | 548 | CS007578-NL |
| CS012040 | LP-379-a-L6-(NH-C6)sccugaaAfuGfcUfugaugauacas-(C6-S)-LP-371-a | 549 | CS007578-NL |
| CS015443 | LP-379-a-L6-(NH-C6)s(invAb)sga_2NaaugcuUfGfAfugauacaa_2Nuas(invAb)-(C6-SS)-MeC5-dT | 550 | CS005174-NL |

I = inosine (hypoxanthine nucleobase) nucleotide
($A^{2N}$) = 2-aminoadenosine nucleotide TABLE 6a ALK7 Agent Sense Strand Sequences (Shown with lipid moiety.)
The structures of the lipid moieties are shown in Table 11.

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS005429 | LP-379-a-L6-(NH-C6)s(invAb)sgugaagcaCfGfAfuucuaucauas(invAb)-(C6-S)-LP-371-a | 530 | GUGAAGCACGAUUCUAUCAUA | 653 |
| CS005430 | LP-379-a-L6-(NH-C6)s(invAb)sgagacauaCfCfCfcagaauccuas(invAb)-(C6-S)-LP-371-a | 531 | GAGACAUACCCCAGAAUCCUA | 654 |
| CS005431 | LP-379-a-L6-(NH-C6)s(invAb)sagcgagcuGfAfCfaucuauucgas(invAb)-(C6-S)-LP-371-a | 532 | AGCGAGCUGACAUCUAUUCGA | 655 |
| CS007081 | LP-379-a-L6-(NH-C6)s(invAb)sga_2NaaugcuUfGfAfugauacaa_2Nuas(invAb)-(C6-S)-LP-371-a | 533 | G(A$^{2N}$)AAUGCUUGAUGAUACA(A$^{2N}$)UA | 613 |
| CS007082 | LP-379-a-L6-(NH-C6)s(invAb)sccugaaauGfCfUfugaugauacas(invAb)-(C6-S)-LP-371-a | 534 | CCUGAAAUGCUUGAUGAUACA | 612 |
| CS007437 | LP-379-a-L6-(NH-C6)s(invAb)sgucugucaUfAfGfuuccaacaaus(invAb)-(C6-S)-LP-371-a | 535 | GUCUGUCAUAGUUCCAACAAU | 599 |
| CS007438 | LP-379-a-L6-(NH-C6)s(invAb)sgcugguauCfUfGfaauaucaugas(invAb)-(C6-S)-LP-371-a | 536 | GCUGGUAUCUGAAUAUCAUGA | 600 |
| CS007966 | LP-379-a-L6-(NH-C6)s(invAb)sccugaaauGfcUfuGfaugauacas(invAb)-(C6-S)-LP-371-a | 537 | CCUGAAAUGCUUGAUGAUACA | 612 |
| CS007967 | LP-379-a-L6-(NH-C6)s(invAb)sccugaaauGfCfuUfgaugauacas(invAb)-(C6-S)-LP-371-a | 538 | CCUGAAAUGCUUGAUGAUACA | 612 |
| CS007968 | LP-379-a-L6-(NH-C6)s(invAb)sccugaaAfugCfUfugaugauacas(invAb)-(C6-S)-LP-371-a | 539 | CCUGAAAUGCUUGAUGAUACA | 612 |
| CS007969 | LP-379-a-L6-(NH-C6)s(invAb)sccugaaAfuGfcUfugaugauacas(invAb)-(C6-S)-LP-371-a | 540 | CCUGAAAUGCUUGAUGAUACA | 612 |
| CS007970 | LP-379-a-L6-(NH-C6)s(invAb)sgaaaugcuUfGfAfugauacaauas(invAb)-(C6-S)-LP-371-a | 541 | GAAAUGCUUGAUGAUACAAUA | 622 |
| CS007971 | LP-379-a-L6-(NH-C6)s(invAb)sga_2NaaugcuUfgAfuGfauacaa_2Nuas(invAb)-(C6-S)-LP-371-a | 542 | G(A$^{2N}$)AAUGCUUGAUGAUACA(A$^{2N}$)UA | 613 |
| CS007972 | LP-379-a-L6-(NH-C6)s(invAb)sga_2NaaugcuUfGfaUfgauacaa_2Nuas(invAb)-(C6-S)-LP-371-a | 543 | G(A$^{2N}$)AAUGCUUGAUGAUACA(A$^{2N}$)UA | 613 |
| CS007973 | LP-379-a-L6-(NH-C6)s(invAb)sga_2NaaugCfuuGfAfugauacaa_2Nuas(invAb)-(C6-S)-LP-371-a | 544 | G(A$^{2N}$)AAUGCUUGAUGAUACA(A$^{2N}$)UA | 613 |
| CS007974 | LP-379-a-L6-(NH-C6)s(invAb)sga_2NaaugCfuUfgAfugauacaa_2Nuas(invAb)-(C6-S)-LP-371-a | 545 | G(A$^{2N}$)AAUGCUUGAUGAUACA(A$^{2N}$)UA | 613 |
| CS009133 | LP-379-a-L6-(NH-C6)s(invAb)sgucuucugUfCfAfuaguuccaaas(invAb)-(C6-S)-LP-371-a | 546 | GUCUUCUGUCAUAGUUCCAAA | 598 |
| CS010070 | LP-379-a-L6-(NH-C6)s(invAb)sgucugucaUfAfGfuuccaacaaus(invAb)-(C6-SS)-MeC5-dT | 547 | GUCUGUCAUAGUUCCAACAAUT | 630 |

TABLE 6a-continued

ALK7 Agent Sense Strand Sequences (Shown with lipid moiety.) The structures of the lipid moieties are shown in Table 11.

| Strand ID | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| CS011693 | LP-379-a-L6-(NH-C6)sccugaaAfuGfcUfugaugauacas-(C6-SS)-MeC5-dT | 548 | CCUGAAAUGCUUGAUGAUACAT | 643 |
| CS012040 | LP-379-a-L6-(NH-C6)sccugaaAfuGfcUfugaugauacas-(C6-S)-LP-371-a | 549 | CCUGAAAUGCUUGAUGAUACA | 612 |
| CS015443 | LP-379-a-L6-(NH-C6)s(invAb)sga_2NaaugcuUfGfAfugauacaa_2Nuas(invAb)-(C6-SS)-MeC5-dT | 550 | G($A^{2N}$)AAUGCUUGAUGAUACA($A^{2N}$)UAT | 644 |

I = inosine (hypoxanthine nucleobase) nucleotide
($A^{2N}$) = 2-aminoadenosine nucleotide The ALK7 RNAi agents disclosed herein are formed by annealing an antisense strand with a sense strand. A sense strand containing a sequence listed in Table 2, Table 4, Table 5, Table 6, or Table 6a can be hybridized to any antisense strand containing a sequence listed in Table 2 or Table 3, provided the two sequences have a region of at least 85% complementarity over a contiguous 16, 17, 18, 19, 20, or 21 nucleotide sequence.

As shown in Table 5 above, certain of the example ALK7 RNAi agent nucleotide sequences are shown to further include reactive linking groups at one or both of the 5' terminal end and the 3' terminal end of the sense strand. For example, many of the ALK7 RNAi agent sense strand sequences shown in Table 5 above have a (NH2-C6) linking group at the 5' end of the nucleotide sequence. Other linking groups, such as a (6-SS-6) linking group or a (C6-SS—C6) linking group, may be present as well or alternatively in certain embodiments. Such reactive linking groups are positioned to facilitate the linking of targeting ligands, targeting groups, and/or PK/PD modulators to the ALK7 RNAi agents disclosed herein. Linking or conjugation reactions are well known in the art and provide for formation of covalent linkages between two molecules or reactants. Suitable conjugation reactions for use in the scope of the inventions herein include, but are not limited to, amide coupling reaction, Michael addition reaction, hydrazone formation reaction, inverse-demand Diels-Alder cycloaddition reaction, oxime ligation, and Copper (I)-catalyzed or strain-promoted azide-alkyne cycloaddition reaction cycloaddition reaction.

In some embodiments, targeting ligands, can be synthesized as activated esters, such as tetrafluorophenyl (TFP) esters, which can be displaced by a reactive amino group (e.g., $NH_2$—$C_6$) to attach the targeting ligand to the ALK7 RNAi agents disclosed herein. In some embodiments, targeting ligands are synthesized as azides, which can be conjugated to a propargyl or DBCO group, for example, via Copper (I)-catalyzed or strain-promoted azide-alkyne cycloaddition reaction.

Additionally, certain of the nucleotide sequences can be synthesized with a dT nucleotide at the 3' terminal end of the sense strand, followed by (3'→5') a linker (e.g., C6-SS—C6). The linker can, in some embodiments, facilitate the linkage to additional components, such as, for example, a lipid or one or more targeting ligands. As described herein, the disulfide bond of C6-SS—C6 is first reduced, removing the dT from the molecule, which can then facilitate the conjugation of the desired component. The terminal dT nucleotide therefore is not a part of the fully conjugated construct.

In some embodiments, the antisense strand of an ALK7 RNAi agent disclosed herein differs by 0, 1, 2, or 3 nucleotides from any of the antisense strand sequences in Table 3 or Table 10. In some embodiments, the sense strand of an ALK7 RNAi agent disclosed herein differs by 0, 1, 2, or 3 nucleotides from any of the sense strand sequences in Table 4, Table 5, Table 6, Table 6a, or Table 10.

In some embodiments, an ALK7 RNAi agent antisense strand comprises a nucleotide sequence of any of the sequences in Table 2 or Table 3. In some embodiments, an ALK7 RNAi agent antisense strand comprises the sequence of nucleotides (from 5' end→3' end) 1-17, 2-17, 1-18, 2-18, 1-19, 2-19, 1-20, 2-20, 1-21, 2-21, 1-22, 2-22, 1-23, 2-23, 1-24, or 2-24 of any of the sequences in Table 2, Table 3, or Table 10. In certain embodiments, an ALK7 RNAi agent antisense strand comprises or consists of a modified sequence of any one of the modified sequences in Table 3 or Table 10.

In some embodiments, an ALK7 RNAi agent sense strand comprises the nucleotide sequence of any of the sequences in Table 2 or Table 4. In some embodiments, an ALK7 RNAi agent sense strand comprises the sequence of nucleotides (from 5' end→3' end) 1-17, 2-17, 3-17, 4-17, 1-18, 2-18, 3-18, 4-18, 1-19, 2-19, 3-19, 4-19, 1-20, 2-20, 3-20, 4-20, 1-21, 2-21, 3-21, 4-21, 1-22, 2-22, 3-22, 4-22, 1-23, 2-23, 3-23, 4-23, 1-24, 2-24, 3-24, or 4-24, of any of the sequences in Table 2, Table 4, Table 5, Table 6, Table 6a or Table 10. In certain embodiments, an ALK7 RNAi agent sense strand comprises or consists of a modified sequence of any one of the modified sequences in Table 3 or Table 10.

For the RNAi agents disclosed herein, the nucleotide at position 1 of the antisense strand (from 5' end→3' end) can be perfectly complementary to an ALK7 gene, or can be non-complementary to an ALK7 gene. In some embodiments, the nucleotide at position 1 of the antisense strand (from 5' end→3' end) is a U, A, or dT (or a modified version of U, A or dT). In some embodiments, the nucleotide at position 1 of the antisense strand (from 5' end→3' end) forms an A:U or U:A base pair with the sense strand.

In some embodiments, an ALK7 RNAi agent antisense strand comprises the sequence of nucleotides (from 5' end→3' end) 2-18 or 2-19 of any of the antisense strand sequences in Table 2, Table 3, or Table 10. In some embodiments, an ALK7 RNAi sense strand comprises the sequence of nucleotides (from 5' end→3' end) 1-17 or 1-18 of any of the sense strand sequences in Table 2, Table 4, Table 5, Table 6, Table 6a or Table 10.

In some embodiments, an ALK7 RNAi agent includes (i) an antisense strand comprising the sequence of nucleotides (from 5' end→3' end) 2-18 or 2-19 of any of the antisense strand sequences in Table 2, Table 3, or Table 10, and (ii) a sense strand comprising the sequence of nucleotides (from 5' end→3' end) 1-17 or 1-18 of any of the sense strand sequences in Table 2, Table 4, Table 5, Table 6, Table 6a or Table 10.

A sense strand containing a sequence listed in Table 2 or Table 4 can be hybridized to any antisense strand containing a sequence listed in Table 2 or Table 3 provided the two sequences have a region of at least 85% complementarity over a contiguous 16, 17, 18, 19, 20, or 21 nucleotide sequence. In some embodiments, the ALK7 RNAi agent has a sense strand consisting of the modified sequence of any of the modified sequences in Table 4, Table 5, Table 6, Table 6a, or Table 10, and an antisense strand consisting of the modified sequence of any of the modified sequences in Table 3 or Table 10. Certain representative sequence pairings are exemplified by the Duplex ID Nos. shown in Tables 7A, 7B, 8, and 9A.

In some embodiments, an ALK7 RNAi agent comprises, consists of, or consists essentially of a duplex represented by any one of the Duplex ID Nos. presented herein. In some embodiments, an ALK7 RNAi agent consists of any of the Duplex ID Nos. presented herein. In some embodiments, an ALK7 RNAi agent comprises the sense strand and antisense strand nucleotide sequences of any of the Duplex ID Nos. presented herein. In some embodiments, an ALK7 RNAi agent comprises the sense strand and antisense strand nucleotide sequences of any of the Duplex ID Nos. presented herein and a targeting group, linking group, PK/PD modulator and/or other non-nucleotide group wherein the targeting group, linking group, PK/PD modulator and/or other non-nucleotide group is covalently linked (i.e., conjugated) to the sense strand or the antisense strand. In some embodiments, an ALK7 RNAi agent includes the sense strand and antisense strand modified nucleotide sequences of any of the Duplex ID Nos. presented herein. In some embodiments, an ALK7 RNAi agent comprises the sense strand and antisense strand modified nucleotide sequences of any of the Duplex ID Nos. presented herein and a targeting group, linking group, and/or other non-nucleotide group, wherein the targeting group, linking group, PK/PD modulator and/or other non-nucleotide group is covalently linked to the sense strand or the antisense strand.

In some embodiments, an ALK7 RNAi agent comprises an antisense strand and a sense strand having the nucleotide sequences of any of the antisense strand/sense strand duplexes of Tables 2, 7A, 7B, 8, 9A, or 10, and comprises a PK/PD modulator. In some embodiments, an ALK7 RNAi agent comprises an antisense strand and a sense strand having the nucleotide sequences of any of the antisense strand/sense strand duplexes of Tables 2, 7A, 7B, 8, 9A, or 10, and comprises one or more lipid moieties.

In some embodiments, an ALK7 RNAi agent comprises an antisense strand and a sense strand having the nucleotide sequences of any of the antisense strand/sense strand duplexes of Tables 2, 7A, 7B, 8, 9A, or 10, and comprises a lipid moiety. In some embodiments, an ALK7 RNAi agent comprises an antisense strand and a sense strand having the nucleotide sequences of any of the antisense strand/sense strand duplexes of Tables 2, 7A, 7B, 8, 9A, or 10, and comprises one or more lipid moieties.

In some embodiments, an ALK7 RNAi agent comprises an antisense strand and a sense strand having the modified nucleotide sequences of any of the antisense strand/sense strand duplexes of Tables 7A, 7B, 8, 9A, and 10.

In some embodiments, an ALK7 RNAi agent comprises an antisense strand and a sense strand having the modified nucleotide sequences of any of the antisense strand/sense strand duplexes of Tables 7A, 7B, 8, 9A, and 10, and comprises a lipid moiety.

In some embodiments, an ALK7 RNAi agent comprises, consists of, or consists essentially of any of the duplexes of Tables 7A, 7B, 8, 9A, and 10.

TABLE 7A

ALK7 RNAi Agent Duplexes with Corresponding Sense and Antisense Strand ID Numbers and Sequence ID numbers for the modified and unmodified nucleotide sequences. (Shown without Linking Agents or Conjugates)

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC004151 | CA005139 | 265 | 554 | CS005138-NL | 360 | 595 |
| AC004152 | CA005141 | 266 | 555 | CS005140-NL | 361 | 596 |
| AC004153 | CA005143 | 267 | 556 | CS005142-NL | 362 | 597 |
| AC004154 | CA005145 | 268 | 557 | CS005144-NL | 363 | 598 |
| AC004155 | CA005147 | 269 | 558 | CS005146-NL | 364 | 599 |
| AC004156 | CA005149 | 270 | 559 | CS005148-NL | 365 | 600 |
| AC004157 | CA005151 | 271 | 560 | CS005150-NL | 366 | 601 |
| AC004158 | CA005153 | 272 | 561 | CS005152-NL | 367 | 602 |
| AC004159 | CA005155 | 273 | 562 | CS005154-NL | 368 | 603 |
| AC004160 | CA005157 | 274 | 563 | CS005156-NL | 369 | 604 |
| AC004161 | CA005159 | 275 | 564 | CS005158-NL | 370 | 605 |
| AC004162 | CA005161 | 276 | 565 | CS005160-NL | 371 | 606 |
| AC004163 | CA005163 | 277 | 566 | CS005162-NL | 372 | 607 |
| AC004164 | CA005165 | 278 | 567 | CS005164-NL | 373 | 608 |
| AC004165 | CA005167 | 279 | 568 | CS005166-NL | 374 | 609 |
| AC004166 | CA005169 | 280 | 569 | CS005168-NL | 375 | 610 |
| AC004167 | CA005171 | 281 | 570 | CS005170-NL | 376 | 611 |
| AC004168 | CA005173 | 282 | 571 | CS005172-NL | 377 | 612 |
| AC004169 | CA005175 | 283 | 572 | CS005174-NL | 378 | 613 |
| AC004170 | CA005177 | 284 | 573 | CS005176-NL | 379 | 614 |
| AC004171 | CA005179 | 285 | 574 | CS005178-NL | 380 | 615 |
| AC004172 | CA005181 | 286 | 575 | CS005180-NL | 381 | 616 |

TABLE 7A-continued

ALK7 RNAi Agent Duplexes with Corresponding Sense and Antisense Strand ID Numbers and Sequence ID numbers for the modified and unmodified nucleotide sequences. (Shown without Linking Agents or Conjugates)

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC004173 | CA005183 | 287 | 576 | CS005182-NL | 382 | 617 |
| AC004174 | CA005185 | 288 | 577 | CS005184-NL | 383 | 618 |
| AC004175 | CA005187 | 289 | 578 | CS005186-NL | 384 | 619 |
| AC004176 | CA005189 | 290 | 579 | CS005188-NL | 385 | 620 |
| AC004197 | CA005139 | 265 | 554 | CS005209-NL | 386 | 595 |
| AC004198 | CA005141 | 266 | 555 | CS005210-NL | 387 | 596 |
| AC004199 | CA005143 | 267 | 556 | CS005211-NL | 388 | 597 |
| AC004200 | CA005145 | 268 | 557 | CS005212-NL | 389 | 598 |
| AC004201 | CA005147 | 269 | 558 | CS005213-NL | 390 | 599 |
| AC004202 | CA005149 | 270 | 559 | CS005214-NL | 391 | 600 |
| AC004203 | CA005151 | 271 | 560 | CS005215-NL | 392 | 601 |
| AC004204 | CA005153 | 272 | 561 | CS005216-NL | 393 | 602 |
| AC004205 | CA005155 | 273 | 562 | CS005217-NL | 394 | 603 |
| AC004206 | CA005157 | 274 | 563 | CS005218-NL | 395 | 604 |
| AC004207 | CA005159 | 275 | 564 | CS005219-NL | 396 | 605 |
| AC004208 | CA005161 | 276 | 565 | CS005220-NL | 397 | 606 |
| AC004209 | CA005163 | 277 | 566 | CS005221-NL | 398 | 607 |
| AC004210 | CA005165 | 278 | 567 | CS005222-NL | 399 | 608 |
| AC004211 | CA005167 | 279 | 568 | CS005223-NL | 400 | 609 |
| AC004212 | CA005169 | 280 | 569 | CS005224-NL | 401 | 610 |
| AC004213 | CA005171 | 281 | 570 | CS005225-NL | 402 | 611 |
| AC004214 | CA005173 | 282 | 571 | CS005226-NL | 403 | 612 |
| AC004215 | CA005175 | 283 | 572 | CS005227-NL | 404 | 613 |
| AC004216 | CA005177 | 284 | 573 | CS005228-NL | 405 | 614 |
| AC004217 | CA005179 | 285 | 574 | CS005229-NL | 406 | 615 |
| AC004218 | CA005181 | 286 | 575 | CS005230-NL | 407 | 616 |
| AC004219 | CA005183 | 287 | 576 | CS005231-NL | 408 | 617 |
| AC004220 | CA005185 | 288 | 577 | CS005232-NL | 409 | 618 |
| AC004221 | CA005187 | 289 | 578 | CS005233-NL | 410 | 619 |
| AC004222 | CA005189 | 290 | 579 | CS005234-NL | 411 | 620 |
| AC005846 | CA007125 | 292 | 557 | CS005212-NL | 389 | 598 |
| AC005847 | CA005145 | 268 | 557 | CS007126-NL | 412 | 598 |
| AC005848 | CA005145 | 268 | 557 | CS007127-NL | 413 | 598 |
| AC005849 | CA005145 | 268 | 557 | CS007128-NL | 414 | 598 |
| AC005850 | CA005145 | 268 | 557 | CS007129-NL | 415 | 598 |
| AC005851 | CA007130 | 293 | 557 | CS005212-NL | 389 | 598 |
| AC005852 | CA007131 | 294 | 557 | CS005212-NL | 389 | 598 |
| AC005853 | CA007132 | 295 | 557 | CS005212-NL | 389 | 598 |
| AC005854 | CA007134 | 297 | 557 | CS005212-NL | 389 | 598 |
| AC005855 | CA007133 | 296 | 557 | CS005212-NL | 389 | 598 |
| AC005856 | CA007135 | 298 | 558 | CS005213-NL | 390 | 599 |
| AC005857 | CA007137 | 299 | 580 | CS007136-NL | 416 | 621 |
| AC005858 | CA005147 | 269 | 558 | CS007138-NL | 417 | 599 |
| AC005859 | CA005147 | 269 | 558 | CS007139-NL | 418 | 599 |
| AC005860 | CA005147 | 269 | 558 | CS007140-NL | 419 | 599 |
| AC005861 | CA005147 | 269 | 558 | CS007141-NL | 420 | 599 |
| AC005862 | CA007142 | 300 | 558 | CS005213-NL | 390 | 599 |
| AC005863 | CA007143 | 301 | 558 | CS005213-NL | 390 | 599 |
| AC005864 | CA007144 | 302 | 558 | CS005213-NL | 390 | 599 |
| AC005865 | CA007145 | 303 | 558 | CS005213-NL | 390 | 599 |
| AC005867 | CA007147 | 304 | 559 | CS005214-NL | 391 | 600 |
| AC005868 | CA005149 | 270 | 559 | CS007148-NL | 421 | 600 |
| AC005869 | CA005149 | 270 | 559 | CS007149-NL | 422 | 600 |
| AC005870 | CA005149 | 270 | 559 | CS007150-NL | 423 | 600 |
| AC005871 | CA005149 | 270 | 559 | CS007151-NL | 424 | 600 |
| AC005872 | CA007152 | 305 | 559 | CS005214-NL | 391 | 600 |
| AC005873 | CA007153 | 306 | 559 | CS005214-NL | 391 | 600 |
| AC005874 | CA007154 | 307 | 559 | CS005214-NL | 391 | 600 |
| AC005875 | CA007155 | 308 | 559 | CS005214-NL | 391 | 600 |
| AC005876 | CA007156 | 309 | 559 | CS005214-NL | 391 | 600 |
| AC006111 | CA007379 | 310 | 581 | CS005213-NL | 390 | 599 |
| AC006290 | CA007563 | 312 | 569 | CS005224-NL | 401 | 610 |
| AC006291 | CA005169 | 280 | 569 | CS007564-NL | 425 | 610 |
| AC006292 | CA005169 | 280 | 569 | CS007565-NL | 426 | 610 |
| AC006293 | CA005169 | 280 | 569 | CS007566-NL | 427 | 610 |
| AC006294 | CA005169 | 280 | 569 | CS007567-NL | 428 | 610 |
| AC006295 | CA007568 | 313 | 569 | CS005224-NL | 401 | 610 |
| AC006296 | CA007569 | 314 | 569 | CS005224-NL | 401 | 610 |
| AC006297 | CA007570 | 315 | 569 | CS005224-NL | 401 | 610 |
| AC006298 | CA007571 | 316 | 569 | CS005224-NL | 401 | 610 |
| AC006299 | CA007572 | 317 | 569 | CS005224-NL | 401 | 610 |
| AC006300 | CA007573 | 318 | 569 | CS005224-NL | 401 | 610 |

TABLE 7A-continued

ALK7 RNAi Agent Duplexes with Corresponding Sense and Antisense Strand ID Numbers and Sequence ID numbers for the modified and unmodified nucleotide sequences. (Shown without Linking Agents or Conjugates)

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC006305 | CA005173 | 282 | 571 | CS007578-NL | 429 | 612 |
| AC006425 | CA005175 | 283 | 572 | CS007711-NL | 430 | 622 |
| AC006427 | CA005175 | 283 | 572 | CS007712-NL | 431 | 613 |
| AC006428 | CA005175 | 283 | 572 | CS007713-NL | 432 | 613 |
| AC006429 | CA005175 | 283 | 572 | CS007714-NL | 433 | 613 |
| AC006430 | CA005175 | 283 | 572 | CS007715-NL | 434 | 613 |
| AC006431 | CA007591 | 327 | 572 | CS005174-NL | 378 | 613 |
| AC006432 | CA007592 | 328 | 572 | CS005174-NL | 378 | 613 |
| AC006433 | CA007593 | 329 | 572 | CS005174-NL | 378 | 613 |
| AC006434 | CA007594 | 330 | 572 | CS005174-NL | 378 | 613 |
| AC006435 | CA007595 | 331 | 572 | CS005174-NL | 378 | 613 |
| AC006436 | CA007596 | 332 | 572 | CS005174-NL | 378 | 613 |
| AC006437 | CA007574 | 319 | 571 | CS005172-NL | 377 | 612 |
| AC006438 | CA005173 | 282 | 571 | CS007716-NL | 435 | 612 |
| AC006439 | CA005173 | 282 | 571 | CS007717-NL | 436 | 612 |
| AC006440 | CA005173 | 282 | 571 | CS007718-NL | 437 | 612 |
| AC006441 | CA005173 | 282 | 571 | CS007719-NL | 438 | 612 |
| AC006442 | CA007579 | 320 | 571 | CS005172-NL | 377 | 612 |
| AC006443 | CA007580 | 321 | 571 | CS005172-NL | 377 | 612 |
| AC006444 | CA007581 | 322 | 571 | CS005172-NL | 377 | 612 |
| AC006445 | CA007582 | 323 | 571 | CS005172-NL | 377 | 612 |
| AC006446 | CA007583 | 324 | 571 | CS005172-NL | 377 | 612 |
| AC006447 | CA007584 | 325 | 571 | CS005172-NL | 377 | 612 |
| AC006734 | CA008042 | 333 | 571 | CS007716-NL | 435 | 612 |
| AC006735 | CA008047 | 334 | 571 | CS007716-NL | 435 | 612 |
| AC006738 | CA008050 | 335 | 581 | CS005213-NL | 390 | 599 |
| AC006741 | CA008052 | 336 | 559 | CS005214-NL | 391 | 600 |
| AC006742 | CA008052 | 336 | 559 | CS007148-NL | 421 | 600 |
| AC006743 | CA008053 | 337 | 559 | CS007148-NL | 421 | 600 |
| AC006744 | CA008054 | 338 | 569 | CS005224-NL | 401 | 610 |
| AC006745 | CA008054 | 338 | 569 | CS007564-NL | 425 | 610 |
| AC006746 | CA008055 | 339 | 569 | CS007564-NL | 425 | 610 |
| AC006747 | CA008050 | 335 | 581 | CS007138-NL | 417 | 599 |
| AC006773 | CA008087 | 340 | 581 | CS007138-NL | 417 | 599 |
| AC007192 | CA008542 | 341 | 582 | CS007126-NL | 412 | 598 |
| AC007193 | CA008544 | 342 | 583 | CS008543-NL | 439 | 623 |
| AC007194 | CA008546 | 343 | 584 | CS008545-NL | 440 | 624 |
| AC007195 | CA008547 | 344 | 585 | CS008543-NL | 439 | 623 |
| AC007196 | CA008548 | 345 | 586 | CS008545-NL | 440 | 624 |
| AC007197 | CA008550 | 346 | 587 | CS008549-NL | 441 | 625 |
| AC007198 | CA008551 | 347 | 588 | CS008549-NL | 441 | 625 |
| AC007199 | CA008553 | 348 | 580 | CS008552-NL | 442 | 621 |
| AC007200 | CA008554 | 349 | 581 | CS007138-NL | 417 | 599 |
| AC007201 | CA008555 | 350 | 581 | CS007138-NL | 417 | 599 |
| AC007202 | CA007137 | 299 | 580 | CS008552-NL | 442 | 621 |
| AC007203 | CA007380 | 311 | 581 | CS007138-NL | 417 | 599 |
| AC007204 | CA008556 | 351 | 581 | CS007138-NL | 417 | 599 |
| AC008318 | CA009908 | 352 | 557 | CS007126-NL | 412 | 598 |
| AC008319 | CA009909 | 353 | 589 | CS007126-NL | 412 | 598 |
| AC008320 | CA009910 | 354 | 589 | CS007126-NL | 412 | 598 |
| AC008321 | CA009911 | 355 | 590 | CS008543-NL | 439 | 623 |
| AC008322 | CA009912 | 356 | 591 | CS007126-NL | 412 | 598 |
| AC008323 | CA009913 | 357 | 592 | CS008543-NL | 439 | 623 |
| AC008324 | CA009914 | 358 | 593 | CS007126-NL | 412 | 598 |
| AC008325 | CA009915 | 359 | 594 | CS007126-NL | 412 | 598 |
| AC008484 | CA007380 | 311 | 581 | CS005146-NL | 364 | 599 |
| AC009978 | CA005173 | 282 | 571 | CS011689-NL | 443 | 612 |
| AC009980 | CA005173 | 282 | 571 | CS011691-NL | 444 | 612 |

TABLE 7B

ALK7 RNAi Agent Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC004151 | CA005139 | 265 | 554 | CS005138 | 445 | 626 |
| AC004152 | CA005141 | 266 | 555 | CS005140 | 446 | 627 |
| AC004153 | CA005143 | 267 | 556 | CS005142 | 447 | 628 |
| AC004154 | CA005145 | 268 | 557 | CS005144 | 448 | 629 |
| AC004155 | CA005147 | 269 | 558 | CS005146 | 449 | 630 |
| AC004156 | CA005149 | 270 | 559 | CS005148 | 450 | 631 |
| AC004157 | CA005151 | 271 | 560 | CS005150 | 451 | 632 |
| AC004158 | CA005153 | 272 | 561 | CS005152 | 452 | 633 |
| AC004159 | CA005155 | 273 | 562 | CS005154 | 453 | 634 |
| AC004160 | CA005157 | 274 | 563 | CS005156 | 454 | 635 |
| AC004161 | CA005159 | 275 | 564 | CS005158 | 455 | 636 |
| AC004162 | CA005161 | 276 | 565 | CS005160 | 456 | 637 |
| AC004163 | CA005163 | 277 | 566 | CS005162 | 457 | 638 |
| AC004164 | CA005165 | 278 | 567 | CS005164 | 458 | 639 |
| AC004165 | CA005167 | 279 | 568 | CS005166 | 459 | 640 |
| AC004166 | CA005169 | 280 | 569 | CS005168 | 460 | 641 |
| AC004167 | CA005171 | 281 | 570 | CS005170 | 461 | 642 |
| AC004168 | CA005173 | 282 | 571 | CS005172 | 462 | 643 |
| AC004169 | CA005175 | 283 | 572 | CS005174 | 463 | 644 |
| AC004170 | CA005177 | 284 | 573 | CS005176 | 464 | 645 |
| AC004171 | CA005179 | 285 | 574 | CS005178 | 465 | 646 |
| AC004172 | CA005181 | 286 | 575 | CS005180 | 466 | 647 |
| AC004173 | CA005183 | 287 | 576 | CS005182 | 467 | 648 |
| AC004174 | CA005185 | 288 | 577 | CS005184 | 468 | 649 |
| AC004175 | CA005187 | 289 | 578 | CS005186 | 469 | 650 |
| AC004176 | CA005189 | 290 | 579 | CS005188 | 470 | 651 |
| AC004197 | CA005139 | 265 | 554 | CS005209 | 471 | 595 |
| AC004198 | CA005141 | 266 | 555 | CS005210 | 472 | 596 |
| AC004199 | CA005143 | 267 | 556 | CS005211 | 473 | 597 |
| AC004200 | CA005145 | 268 | 557 | CS005212 | 474 | 598 |
| AC004201 | CA005147 | 269 | 558 | CS005213 | 475 | 599 |
| AC004202 | CA005149 | 270 | 559 | CS005214 | 476 | 600 |
| AC004203 | CA005151 | 271 | 560 | CS005215 | 477 | 601 |
| AC004204 | CA005153 | 272 | 561 | CS005216 | 478 | 602 |
| AC004205 | CA005155 | 273 | 562 | CS005217 | 479 | 603 |
| AC004206 | CA005157 | 274 | 563 | CS005218 | 480 | 604 |
| AC004207 | CA005159 | 275 | 564 | CS005219 | 481 | 605 |
| AC004208 | CA005161 | 276 | 565 | CS005220 | 482 | 606 |
| AC004209 | CA005163 | 277 | 566 | CS005221 | 483 | 607 |
| AC004210 | CA005165 | 278 | 567 | CS005222 | 484 | 608 |
| AC004211 | CA005167 | 279 | 568 | CS005223 | 485 | 609 |
| AC004212 | CA005169 | 280 | 569 | CS005224 | 486 | 610 |
| AC004213 | CA005171 | 281 | 570 | CS005225 | 487 | 611 |
| AC004214 | CA005173 | 282 | 571 | CS005226 | 488 | 612 |
| AC004215 | CA005175 | 283 | 572 | CS005227 | 489 | 613 |
| AC004216 | CA005177 | 284 | 573 | CS005228 | 490 | 614 |
| AC004217 | CA005179 | 285 | 574 | CS005229 | 491 | 615 |
| AC004218 | CA005181 | 286 | 575 | CS005230 | 492 | 616 |
| AC004219 | CA005183 | 287 | 576 | CS005231 | 493 | 617 |
| AC004220 | CA005185 | 288 | 577 | CS005232 | 494 | 618 |
| AC004221 | CA005187 | 289 | 578 | CS005233 | 495 | 619 |
| AC004222 | CA005189 | 290 | 579 | CS005234 | 496 | 620 |
| AC005846 | CA007125 | 292 | 557 | CS005212 | 474 | 598 |
| AC005847 | CA005145 | 268 | 557 | CS007126 | 497 | 598 |
| AC005848 | CA005145 | 268 | 557 | CS007127 | 498 | 598 |
| AC005849 | CA005145 | 268 | 557 | CS007128 | 499 | 598 |
| AC005850 | CA005145 | 268 | 557 | CS007129 | 500 | 598 |
| AC005851 | CA007130 | 293 | 557 | CS005212 | 474 | 598 |
| AC005852 | CA007131 | 294 | 557 | CS005212 | 474 | 598 |
| AC005853 | CA007132 | 295 | 557 | CS005212 | 474 | 598 |
| AC005854 | CA007134 | 297 | 557 | CS005212 | 474 | 598 |
| AC005855 | CA007133 | 296 | 557 | CS005212 | 474 | 598 |
| AC005856 | CA007135 | 298 | 558 | CS005213 | 475 | 599 |
| AC005857 | CA007137 | 299 | 580 | CS007136 | 501 | 621 |
| AC005858 | CA005147 | 269 | 558 | CS007138 | 502 | 599 |
| AC005859 | CA005147 | 269 | 558 | CS007139 | 503 | 599 |
| AC005860 | CA005147 | 269 | 558 | CS007140 | 504 | 599 |
| AC005861 | CA005147 | 269 | 558 | CS007141 | 505 | 599 |
| AC005862 | CA007142 | 300 | 558 | CS005213 | 475 | 599 |
| AC005863 | CA007143 | 301 | 558 | CS005213 | 475 | 599 |
| AC005864 | CA007144 | 302 | 558 | CS005213 | 475 | 599 |
| AC005865 | CA007145 | 303 | 558 | CS005213 | 475 | 599 |
| AC005867 | CA007147 | 304 | 559 | CS005214 | 476 | 600 |

TABLE 7B-continued

ALK7 RNAi Agent Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC005868 | CA005149 | 270 | 559 | CS007148 | 506 | 600 |
| AC005869 | CA005149 | 270 | 559 | CS007149 | 507 | 600 |
| AC005870 | CA005149 | 270 | 559 | CS007150 | 508 | 600 |
| AC005871 | CA005149 | 270 | 559 | CS007151 | 509 | 600 |
| AC005872 | CA007152 | 305 | 559 | CS005214 | 476 | 600 |
| AC005873 | CA007153 | 306 | 559 | CS005214 | 476 | 600 |
| AC005874 | CA007154 | 307 | 559 | CS005214 | 476 | 600 |
| AC005875 | CA007155 | 308 | 559 | CS005214 | 476 | 600 |
| AC005876 | CA007156 | 309 | 559 | CS005214 | 476 | 600 |
| AC006111 | CA007379 | 310 | 581 | CS005213 | 475 | 599 |
| AC006290 | CA007563 | 312 | 569 | CS005224 | 486 | 610 |
| AC006291 | CA005169 | 280 | 569 | CS007564 | 510 | 610 |
| AC006292 | CA005169 | 280 | 569 | CS007565 | 511 | 610 |
| AC006293 | CA005169 | 280 | 569 | CS007566 | 512 | 610 |
| AC006294 | CA005169 | 280 | 569 | CS007567 | 513 | 610 |
| AC006295 | CA007568 | 313 | 569 | CS005224 | 486 | 610 |
| AC006296 | CA007569 | 314 | 569 | CS005224 | 486 | 610 |
| AC006297 | CA007570 | 315 | 569 | CS005224 | 486 | 610 |
| AC006298 | CA007571 | 316 | 569 | CS005224 | 486 | 610 |
| AC006299 | CA007572 | 317 | 569 | CS005224 | 486 | 610 |
| AC006300 | CA007573 | 318 | 569 | CS005224 | 486 | 610 |
| AC006305 | CA005173 | 282 | 571 | CS007578 | 514 | 612 |
| AC006425 | CA005175 | 283 | 572 | CS007711 | 515 | 652 |
| AC006427 | CA005175 | 283 | 572 | CS007712 | 516 | 644 |
| AC006428 | CA005175 | 283 | 572 | CS007713 | 517 | 644 |
| AC006429 | CA005175 | 283 | 572 | CS007714 | 518 | 644 |
| AC006430 | CA005175 | 283 | 572 | CS007715 | 519 | 644 |
| AC006431 | CA007591 | 327 | 572 | CS005174 | 463 | 644 |
| AC006432 | CA007592 | 328 | 572 | CS005174 | 463 | 644 |
| AC006433 | CA007593 | 329 | 572 | CS005174 | 463 | 644 |
| AC006434 | CA007594 | 330 | 572 | CS005174 | 463 | 644 |
| AC006435 | CA007595 | 331 | 572 | CS005174 | 463 | 644 |
| AC006436 | CA007596 | 332 | 572 | CS005174 | 463 | 644 |
| AC006437 | CA007574 | 319 | 571 | CS005172 | 462 | 643 |
| AC006438 | CA005173 | 282 | 571 | CS007716 | 520 | 643 |
| AC006439 | CA005173 | 282 | 571 | CS007717 | 521 | 643 |
| AC006440 | CA005173 | 282 | 571 | CS007718 | 522 | 643 |
| AC006441 | CA005173 | 282 | 571 | CS007719 | 523 | 643 |
| AC006442 | CA007579 | 320 | 571 | CS005172 | 462 | 643 |
| AC006443 | CA007580 | 321 | 571 | CS005172 | 462 | 643 |
| AC006444 | CA007581 | 322 | 571 | CS005172 | 462 | 643 |
| AC006445 | CA007582 | 323 | 571 | CS005172 | 462 | 643 |
| AC006446 | CA007583 | 324 | 571 | CS005172 | 462 | 643 |
| AC006447 | CA007584 | 325 | 571 | CS005172 | 462 | 643 |
| AC006734 | CA008042 | 333 | 571 | CS007716 | 520 | 643 |
| AC006735 | CA008047 | 334 | 571 | CS007716 | 520 | 643 |
| AC006738 | CA008050 | 335 | 581 | CS005213 | 475 | 599 |
| AC006741 | CA008052 | 336 | 559 | CS005214 | 476 | 600 |
| AC006742 | CA008052 | 336 | 559 | CS007148 | 506 | 600 |
| AC006743 | CA008053 | 337 | 559 | CS007148 | 506 | 600 |
| AC006744 | CA008054 | 338 | 569 | CS005224 | 486 | 610 |
| AC006745 | CA008054 | 338 | 569 | CS007564 | 510 | 610 |
| AC006746 | CA008055 | 339 | 569 | CS007564 | 510 | 610 |
| AC006747 | CA008050 | 335 | 58 | CS007138 | 502 | 599 |
| AC006773 | CA008087 | 340 | 581 | CS007138 | 502 | 599 |
| AC007192 | CA008542 | 341 | 582 | CS007126 | 497 | 598 |
| AC007193 | CA008544 | 342 | 583 | CS008543 | 524 | 623 |
| AC007194 | CA008546 | 343 | 584 | CS008545 | 525 | 624 |
| AC007195 | CA008547 | 344 | 585 | CS008543 | 524 | 623 |
| AC007196 | CA008548 | 345 | 586 | CS008545 | 525 | 624 |
| AC007197 | CA008550 | 346 | 587 | CS008549 | 526 | 625 |
| AC007198 | CA008551 | 347 | 588 | CS008549 | 526 | 625 |
| AC007199 | CA008553 | 348 | 580 | CS008552 | 527 | 621 |
| AC007200 | CA008554 | 349 | 581 | CS007138 | 502 | 599 |
| AC007201 | CA008555 | 350 | 581 | CS007138 | 502 | 599 |
| AC007202 | CA007137 | 299 | 580 | CS008552 | 527 | 621 |
| AC007203 | CA007380 | 311 | 581 | CS007138 | 502 | 599 |
| AC007204 | CA008556 | 351 | 581 | CS007138 | 502 | 599 |
| AC008318 | CA009908 | 352 | 557 | CS007126 | 497 | 598 |
| AC008319 | CA009909 | 353 | 589 | CS007126 | 497 | 598 |
| AC008320 | CA009910 | 354 | 589 | CS007126 | 497 | 598 |
| AC008321 | CA009911 | 355 | 590 | CS008543 | 524 | 623 |
| AC008322 | CA009912 | 356 | 591 | CS007126 | 497 | 598 |

TABLE 7B-continued

ALK7 RNAi Agent Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC008323 | CA009913 | 357 | 592 | CS008543 | 524 | 623 |
| AC008324 | CA009914 | 358 | 593 | CS007126 | 497 | 598 |
| AC008325 | CA009915 | 359 | 594 | CS007126 | 497 | 598 |
| AC008484 | CA007380 | 311 | 581 | CS005146 | 449 | 630 |
| AC009978 | CA005173 | 282 | 571 | CS011689 | 528 | 643 |
| AC009980 | CA005173 | 282 | 571 | CS011691 | 529 | 643 |

TABLE 8

ALK7 RNAi Agent Duplexes with Corresponding Sense and Antisense Strand ID Numbers and Sequence ID numbers for the modified and unmodified nucleotide sequences. (Shown with PK/PD modulators)

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC004390 | CA005127 | 262 | 551 | CS005429 | 530 | 653 |
| AC004391 | CA005129 | 263 | 552 | CS005430 | 531 | 654 |
| AC004392 | CA005131 | 264 | 553 | CS005431 | 532 | 655 |
| AC005181 | CA006102 | 291 | 551 | CS005429 | 530 | 653 |
| AC005823 | CA005175 | 283 | 572 | CS007081 | 533 | 613 |
| AC005824 | CA005173 | 282 | 571 | CS007082 | 534 | 612 |
| AC006188 | CA005147 | 269 | 558 | CS007437 | 535 | 599 |
| AC006189 | CA005149 | 270 | 559 | CS007438 | 536 | 600 |
| AC006643 | CA007574 | 319 | 571 | CS007082 | 534 | 612 |
| AC006644 | CA005173 | 282 | 571 | CS007966 | 537 | 612 |
| AC006645 | CA005173 | 282 | 571 | CS007967 | 538 | 612 |
| AC006646 | CA005173 | 282 | 571 | CS007968 | 539 | 612 |
| AC006647 | CA005173 | 282 | 571 | CS007969 | 540 | 612 |
| AC006648 | CA007579 | 320 | 571 | CS007082 | 534 | 612 |
| AC006649 | CA007580 | 321 | 571 | CS007082 | 534 | 612 |
| AC006650 | CA007581 | 322 | 571 | CS007082 | 534 | 612 |
| AC006651 | CA007582 | 323 | 571 | CS007082 | 534 | 612 |
| AC006652 | CA007583 | 324 | 571 | CS007082 | 534 | 612 |
| AC006653 | CA007584 | 325 | 571 | CS007082 | 534 | 612 |
| AC006654 | CA005175 | 283 | 572 | CS007970 | 541 | 622 |
| AC006655 | CA007586 | 326 | 572 | CS007081 | 533 | 613 |
| AC006656 | CA005175 | 283 | 572 | CS007971 | 542 | 613 |
| AC006657 | CA005175 | 283 | 572 | CS007972 | 543 | 613 |
| AC006658 | CA005175 | 283 | 572 | CS007973 | 544 | 613 |
| AC006659 | CA005175 | 283 | 572 | CS007974 | 545 | 613 |
| AC006660 | CA007591 | 327 | 572 | CS007081 | 533 | 613 |
| AC006661 | CA007592 | 328 | 572 | CS007081 | 533 | 613 |
| AC006662 | CA007593 | 329 | 572 | CS007081 | 533 | 613 |
| AC006663 | CA007594 | 330 | 572 | CS007081 | 533 | 613 |
| AC006664 | CA007595 | 331 | 572 | CS007081 | 533 | 613 |
| AC006665 | CA007596 | 332 | 572 | CS007081 | 533 | 613 |
| AC007027 | CA008042 | 333 | 571 | CS007082 | 534 | 612 |
| AC007028 | CA008047 | 334 | 571 | CS007082 | 534 | 612 |
| AC007029 | CA008042 | 333 | 571 | CS007966 | 537 | 612 |
| AC007030 | CA008047 | 334 | 571 | CS007966 | 537 | 612 |
| AC007694 | CA007125 | 292 | 557 | CS009133 | 546 | 598 |
| AC008492 | CA007380 | 311 | 581 | CS010070 | 547 | 630 |
| AC008546 | CA005147 | 269 | 558 | CS010070 | 547 | 630 |
| AC009982 | CA005173 | 282 | 571 | CS011693 | 548 | 643 |
| AC010357 | CA005173 | 282 | 571 | CS012040 | 549 | 612 |
| AC013158 | CA007586 | 326 | 572 | CS015443 | 550 | 644 |

TABLE 9A

| Conjugate Duplex ID Numbers Referencing Position Targeted On ALK7 Gene | | | |
|---|---|---|---|
| Duplex | AS ID | SS ID | Targeted ALK7 Gene Position (Of SEQ ID NO: 1) |
| AC004390 | CA005127 | CS005429 | N/A |
| AC004391 | CA005129 | CS005430 | N/A |
| AC004392 | CA005131 | CS005431 | N/A |
| AC005181 | CA006102 | CS005429 | N/A |
| AC005823 | CA005175 | CS007081 | 1334 |
| AC005824 | CA005173 | CS007082 | 1331 |
| AC006188 | CA005147 | CS007437 | 440 |
| AC006189 | CA005149 | CS007438 | 1021 |
| AC006643 | CA007574 | CS007082 | 1331 |
| AC006644 | CA005173 | CS007966 | 1331 |
| AC006645 | CA005173 | CS007967 | 1331 |
| AC006646 | CA005173 | CS007968 | 1331 |
| AC006647 | CA005173 | CS007969 | 1331 |
| AC006648 | CA007579 | CS007082 | 1331 |
| AC006649 | CA007580 | CS007082 | 1331 |
| AC006650 | CA007581 | CS007082 | 1331 |
| AC006651 | CA007582 | CS007082 | 1331 |
| AC006652 | CA007583 | CS007082 | 1331 |
| AC006653 | CA007584 | CS007082 | 1331 |
| AC006654 | CA005175 | CS007970 | 1334 |
| AC006655 | CA007586 | CS007081 | 1334 |
| AC006656 | CA005175 | CS007971 | 1334 |
| AC006657 | CA005175 | CS007972 | 1334 |
| AC006658 | CA005175 | CS007973 | 1334 |
| AC006659 | CA005175 | CS007974 | 1334 |
| AC006660 | CA007591 | CS007081 | 1334 |
| AC006661 | CA007592 | CS007081 | 1334 |
| AC006662 | CA007593 | CS007081 | 1334 |
| AC006663 | CA007594 | CS007081 | 1334 |
| AC006664 | CA007595 | CS007081 | 1334 |
| AC006665 | CA007596 | CS007081 | 1334 |
| AC007027 | CA008042 | CS007082 | 1331 |
| AC007028 | CA008047 | CS007082 | 1331 |
| AC007029 | CA008042 | CS007966 | 1331 |
| AC007030 | CA008047 | CS007966 | 1331 |
| AC007694 | CA007125 | CS009133 | 437 |
| AC008492 | CA007380 | CS010070 | 440 |
| AC008546 | CA005147 | CS010070 | 440 |
| AC009982 | CA005173 | CS011693 | 1331 |
| AC010357 | CA005173 | CS012040 | 1331 |
| AC013158 | CA007586 | CS015443 | 1334 |

ALK7 RNAi agent conjugate duplex IDs targeted to mouse ALK7 are denoted with "N/A" for their respective targeted ALK7 gene positions.

TABLE 10

| Conjugate ID Numbers With Chemically Modified Antisense and Sense Strands (including Linkers and Conjugates) | | | | |
|---|---|---|---|---|
| AC ID Number | Sense Strand (Fully Modified with Conjugated PK/PD modulator) (5' → 3') | SEQ ID NO: | Antisense Strand (5' → 3') | SEQ ID NO: |
| AC004390 | LP-379-a-L6-(NH-C6)s(invAb)sgugaagcaCfGfAfuucuaucauas(invAb)-(C6-S)-LP-371-a | 530 | cPrpusAfsugauAfgaauCfgUfgCfuucasc | 262 |
| AC004391 | LP-379-a-L6-(NH-C6)s(invAb)sgagacauaCfCfCfcagaauccuas(invAb)-(C6-S)-LP-371-a | 531 | cPrpusAfsggauUfcuggGfgUfaUfgucusc | 263 |
| AC004392 | LP-379-a-L6-(NH-C6)s(invAb)sagcgagcuGfAfCfaucuauucgas(invAb)-(C6-S)-LP-371-a | 532 | cPrpusCfsgaauAfgaugUfcAfgCfucgcsu | 264 |
| AC005181 | LP-379-a-L6-(NH-C6)s(invAb)sgugaagcaCfGfAfuucuaucauas(invAb)-(C6-S)-LP-371-a | 530 | cPrpusAfsugauagaauCfgUfgCfuucasc | 291 |
| AC005823 | LP-379-a-L6-(NH-C6)s(invAb)sga_2NaaugcuUfGfAfugauacaa_2Nuas(invAb)-(C6-S)-LP-371-a | 533 | cPrpusAfsuuguAfucauCfaAfgCfauuusc | 283 |
| AC005824 | LP-379-a-L6-(NH-C6)s(invAb)sccugaaauGfCfUfugaugauacas(invAb)-(C6-S)-LP-371-a | 534 | cPrpusGfsuaucAfucaaGfcAfuUfucagsg | 282 |
| AC006188 | LP-379-a-L6-(NH-C6)s(invAb)sgucugucaUfAfGfuuccaacaaus(invAb)-(C6-S)-LP-371-a | 535 | cPrpasUfsuguuGfgaacUfaUfgAfcagasc | 269 |
| AC006189 | LP-379-a-L6-(NH-C6)s(invAb)sgcugguauCfUfGfaauaucaugas(invAb)-(C6-S)-LP-371-a | 536 | cPrpusCfsaugaUfauucAfgAfuAfccagsc | 270 |
| AC006643 | LP-379-a-L6-(NH-C6)s(invAb)sccugaaauGfCfUfugaugauacas(invAb)-(C6-S)-LP-371-a | 534 | cPrpusGfsuaucAfucaaGfcAfuUfucasgsg | 319 |
| AC006644 | LP-379-a-L6-(NH-C6)s(invAb)sccugaaauGfcUfuGfaugauacas(invAb)-(C6-S)-LP-371-a | 537 | cPrpusGfsuaucAfucaaGfcAfuUfucagsg | 282 |

TABLE 10-continued

Conjugate ID Numbers With Chemically Modified Antisense and Sense Strands (including Linkers and Conjugates)

| AC ID Number | Sense Strand (Fully Modified with Conjugated PK/PD modulator)(5' → 3') | SEQ ID NO: | Antisense Strand (5' → 3') | SEQ ID NO: |
|---|---|---|---|---|
| AC006645 | LP-379-a-L6-(NH-C6)s(invAb)sccugaaauGfCfuUfgaugauacas(invAb)-(C6-S)-LP-371-a | 538 | cPrpusGfsuaucAfucaaGfcAfuUfucagsg | 282 |
| AC006646 | LP-379-a-L6-(NH-C6)s(invAb)sccugaaAfugCfUfugaugauacas(invAb)-(C6-S)-LP-371-a | 539 | cPrpusGfsuaucAfucaaGfcAfuUfucagsg | 282 |
| AC006647 | LP-379-a-L6-(NH-C6)s(invAb)sccugaaAfuGfcUfugaugauacas(invAb)-(C6-S)-LP-371-a | 540 | cPrpusGfsuaucAfucaaGfcAfuUfucagsg | 282 |
| AC006648 | LP-379-a-L6-(NH-C6)s(invAb)sccugaaauGfCfUfugaugauacas(invAb)-(C6-S)-LP-371-a | 534 | cPrpusGfsuaucaucaaGfcAfuuucagsg | 320 |
| AC006649 | LP-379-a-L6-(NH-C6)s(invAb)sccugaaauGfCfUfugaugauacas(invAb)-(C6-S)-LP-371-a | 534 | cPrpusGfsUfaucaucaaGfcAfuUfucagsg | 321 |
| AC006650 | LP-379-a-L6-(NH-C6)s(invAb)sccugaaauGfCfUfugaugauacas(invAb)-(C6-S)-LP-371-a | 534 | cPrpusGfsuAfucaucaaGfcAfuUfucagsg | 322 |
| AC006651 | LP-379-a-L6-(NH-C6)s(invAb)sccugaaauGfCfUfugaugauacas(invAb)-(C6-S)-LP-371-a | 534 | cPrpusGfsuauCfaucaaGfcAfuUfucagsg | 323 |
| AC006652 | LP-379-a-L6-(NH-C6)s(invAb)sccugaaauGfCfUfugaugauacas(invAb)-(C6-S)-LP-371-a | 534 | cPrpusGfsuauCfaUfcAfaGfcAfuUfucagsg | 324 |
| AC006653 | LP-379-a-L6-(NH-C6)s(invAb)sccugaaauGfCfUfugaugauacas(invAb)-(C6-S)-LP-371-a | 534 | cPrpusGfsuAfuCfaUfcAfaGfcAfuUfucagsg | 325 |
| AC006654 | LP-379-a-L6-(NH-C6)s(invAb)sgaaaugcuUfGfAfugauacaauas(invAb)-(C6-S)-LP-371-a | 541 | cPrpusAfsuuguAfucauCfaAfgCfauuusc | 283 |
| AC006655 | LP-379-a-L6-(NH-C6)s(invAb)sga_2NaaugcuUfGfAfugauacaa_2Nuas(invAb)-(C6-S)-LP-371-a | 533 | cPrpusAfsuuguAfucauCfaAfgCfauusus c | 326 |
| AC006656 | LP-379-a-L6-(NH-C6)s(invAb)sga_2NaaugcuUfgAfuGfauacaa_2Nuas(invAb)-(C6-S)-LP-371-a | 542 | cPrpusAfsuuguAfucauCfaAfgCfauuusc | 283 |
| AC006657 | LP-379-a-L6-(NH-C6)s(invAb)sga_2NaaugcuUfGfaUfgauacaa_2Nuas(invAb)-(C6-S)-LP-371-a | 543 | cPrpusAfsuuguAfucauCfaAfgCfauuusc | 283 |
| AC006658 | LP-379-a-L6-(NH-C6)s(invAb)sga_2NaaugCfuuGfAfugauacaa_2Nuas(invAb)-(C6-S)-LP-371-a | 544 | cPrpusAfsuuguAfucauCfaAfgCfauuusc | 283 |
| AC006659 | LP-379-a-L6-(NH-C6)s(invAb)sga_2NaaugCfuUfgAfugauacaa_2Nuas(invAb)-(C6-S)-LP-371-a | 545 | cPrpusAfsuuguAfucauCfaAfgCfauuusc | 283 |
| AC006660 | LP-379-a-L6-(NH-C6)s(invAb)sga_2NaaugcuUfGfAfugauacaa_2Nuas(invAb)-(C6-S)-LP-371-a | 533 | cPrpusAfsuuguaucauCfaAfgcauuusc | 327 |
| AC006661 | LP-379-a-L6-(NH-C6)s(invAb)sga_2NaaugcuUfGfAfugauacaa_2Nuas(invAb)-(C6-S)-LP-371-a | 533 | cPrpusAfsUfuguaucauCfaAfgCfauuusc | 328 |
| AC006662 | LP-379-a-L6-(NH-C6)s(invAb)sga_2NaaugcuUfGfAfugauacaa_2Nuas(invAb)-(C6-S)-LP-371-a | 533 | cPrpusAfsuUfguaucauCfaAfgCfauuusc | 329 |

TABLE 10-continued

Conjugate ID Numbers With Chemically Modified Antisense and Sense Strands (including Linkers and Conjugates)

| AC ID Number | Sense Strand (Fully Modified with Conjugated PK/PD modulator)(5' → 3') | SEQ ID NO: | Antisense Strand (5' → 3') | SEQ ID NO: |
|---|---|---|---|---|
| AC006663 | LP-379-a-L6-(NH-C6)s(invAb)sga_2NaaugcuUfGfAfugauacaa_2Nuas(invAb)-(C6-S)-LP-371-a | 533 | cPrpusAfsuugUfaucauCfaAfgCfauuusc | 330 |
| AC006664 | LP-379-a-L6-(NH-C6)s(invAb)sga_2NaaugcuUfGfAfugauacaa_2Nuas(invAb)-(C6-S)-LP-371-a | 533 | cPrpusAfsuugUfaUfcAfuCfaAfgCfauuusc | 331 |
| AC006665 | LP-379-a-L6-(NH-C6)s(invAb)sga_2NaaugcuUfGfAfugauacaa_2Nuas(invAb)-(C6-S)-LP-371-a | 533 | cPrpusAfsuUfgUfaUfcAfuCfaAfgCfauuusc | 332 |
| AC007027 | LP-379-a-L6-(NH-C6)s(invAb)sccugaaauGfCfUfugaugauacas(invAb)-(C6-S)-LP-371-a | 534 | cPrpusGfsuaUfcaucaaGfcAfuUfucagsg | 333 |
| AC007028 | LP-379-a-L6-(NH-C6)s(invAb)sccugaaauGfCfUfugaugauacas(invAb)-(C6-S)-LP-371-a | 534 | cPrpusGfsuaUfcaucaaGfcAfuUfucagssg | 334 |
| AC007029 | LP-379-a-L6-(NH-C6)s(invAb)sccugaaauGfcUfuGfaugauacas(invAb)-(C6-S)-LP-371-a | 537 | cPrpusGfsuaUfcaucaaGfcAfuUfucagsg | 333 |
| AC007030 | LP-379-a-L6-(NH-C6)s(invAb)sccugaaauGfcUfuGfaugauacas(invAb)-(C6-S)-LP-371-a | 537 | cPrpusGfsuaUfcaucaaGfcAfuUfucagssg | 334 |
| AC007694 | LP-379-a-L6-(NH-C6)s(invAb)sgucuucugUfCfAfuaguuccaaas(invAb)-(C6-S)-LP-371-a | 546 | cPrpusUfsuggaAfcuauGfaCfaGfaagsasc | 292 |
| AC008492 | LP-379-a-L6-(NH-C6)s(invAb)sgucugucaUfAfGfuuccaacaaus(invAb)-(C6-SS)-MeC5-dT | 547 | cPrpisUfsuguuGfgaacUfaUfgAfcagasc | 311 |
| AC008546 | LP-379-a-L6-(NH-C6)s(invAb)sgucugucaUfAfGfuuccaacaaus(invAb)-(C6-SS)-MeC5-dT | 547 | cPrpasUfsuguuGfgaacUfaUfgAfcagasc | 269 |
| AC009982 | LP-379-a-L6-(NH-C6)sccugaaAfuGfcUfugaugauacas-(C6-SS)-MeC5-dT | 548 | cPrpusGfsuaucAfucaaGfcAfuUfucagsg | 282 |
| AC010357 | LP-379-a-L6-(NH-C6)sccugaaAfuGfcUfugaugauacas-(C6-S)-LP-371-a | 549 | cPrpusGfsuaucAfucaaGfcAfuUfucagsg | 282 |
| AC013158 | LP-379-a-L6-(NH-C6)s(invAb)sga_2NaaugcuUfGfAfugauacaa_2Nuas(invAb)-(C6-SS)-MeC5-dT | 550 | cPrpusAfsuuguAfucauCfaAfgCfauusus c | 326 |

In some embodiments, an ALK7 RNAi agent is prepared or provided as a salt, mixed salt, or a free-acid. In some embodiments, an ALK7 RNAi agent is prepared or provided as a pharmaceutically acceptable salt. In some embodiments, an ALK7 RNAi agent is prepared or provided as a pharmaceutically acceptable sodium or potassium salt The RNAi agents described herein, upon delivery to a cell expressing an ALK7 gene, inhibit or knockdown expression of one or more ALK7 genes in vivo and/or in vitro.

Targeting Groups, Linking Groups, Lipid PK/PD Moieties, and Delivery Vehicles

In some embodiments, an ALK7 RNAi agent contains or is conjugated to one or more non-nucleotide groups including, but not limited to, a targeting group, a linking group, a pharmacokinetic/pharmacodynamic (PK/PD) modulator, a delivery polymer, or a delivery vehicle. The non-nucleotide group can enhance targeting, delivery, or attachment of the RNAi agent. The non-nucleotide group can be covalently linked to the 3' and/or 5' end of either the sense strand and/or the antisense strand. In some embodiments, an ALK7 RNAi agent contains a non-nucleotide group linked to the 3' and/or 5' end of the sense strand. In some embodiments, a non-nucleotide group is linked to the 5' end of an ALK7 RNAi agent sense strand. A non-nucleotide group can be linked directly or indirectly to the RNAi agent via a linker/linking group. In some embodiments, a non-nucleotide group is linked to the RNAi agent via a labile, cleavable, or reversible bond or linker.

In some embodiments, a non-nucleotide group enhances the pharmacokinetic or biodistribution properties of an RNAi agent or conjugate to which it is attached to improve cell- or tissue-specific distribution and cell-specific uptake of the conjugate. In some embodiments, a non-nucleotide group enhances endocytosis of the RNAi agent.

Targeting groups or targeting moieties enhance the pharmacokinetic or biodistribution properties of a conjugate or RNAi agent to which they are attached to improve cell-specific (including, in some cases, organ specific) distribution and cell-specific (or organ specific) uptake of the conjugate or RNAi agent. A targeting group can be monovalent, divalent, trivalent, tetravalent, or have higher valency for the target to which it is directed. Representative targeting groups include, without limitation, compounds with affinity to cell surface molecule, cell receptor ligands, hapten, antibodies, monoclonal antibodies, antibody fragments, and antibody mimics with affinity to cell surface molecules. In some embodiments, a targeting group is linked to an RNAi agent using a linker, such as a PEG linker or one, two, or three abasic and/or ribitol (abasic ribose) residues, which in some instances can serve as linkers.

A targeting group, with or without a linker, can be attached to the 5' or 3' end of any of the sense and/or antisense strands disclosed in Tables 2, 3, 4, 5, 6, and 10. A linker, with or without a targeting group, can be attached to the 5' or 3' end of any of the sense and/or antisense strands disclosed in Tables 2, 3, 4, 5, 6, and 10.

The ALK7 RNAi agents described herein can be synthesized having a reactive group, such as an amino group (also referred to herein as an amine), at the 5'-terminus and/or the 3'-terminus. The reactive group can be used subsequently to attach a targeting moiety using methods typical in the art.

For example, in some embodiments, the ALK7 RNAi agents disclosed herein are synthesized having an $NH_2$—$C_6$ group at the 5'-terminus of the sense strand of the RNAi agent. The terminal amino group subsequently can be reacted to form a conjugate with, for example, a group that includes a lipid moiety. In some embodiments, the ALK7 RNAi agents disclosed herein are synthesized having one or more alkyne groups at the 5'-terminus of the sense strand of the RNAi agent.

In some embodiments, targeting groups are linked to the ALK7 RNAi agents without the use of an additional linker. In some embodiments, the targeting group is designed having a linker readily present to facilitate the linkage to an ALK7 RNAi agent. In some embodiments, when two or more RNAi agents are included in a composition, the two or more RNAi agents can be linked to their respective targeting groups using the same linkers. In some embodiments, when two or more RNAi agents are included in a composition, the two or more RNAi agents are linked to their respective targeting groups using different linkers.

In some embodiments, a linking group is conjugated to the RNAi agent. The linking group facilitates covalent linkage of the agent to a targeting group, pharmacokinetic modulator, delivery polymer, or delivery vehicle. The linking group can be linked to the 3' and/or the 5' end of the RNAi agent sense strand or antisense strand. In some embodiments, the linking group is linked to the RNAi agent sense strand. In some embodiments, the linking group is conjugated to the 5' or 3' end of an RNAi agent sense strand. In some embodiments, a linking group is conjugated to the 5' end of an RNAi agent sense strand. Examples of linking groups, include but are not limited to: C6-SS—C6, 6-SS-6, reactive groups such as primary amines (e.g., NH2-C6) and alkynes, alkyl groups, abasic residues/nucleotides, amino acids, tri-alkyne functionalized groups, ribitol, and/or PEG groups. Examples of certain linking groups are provided in Table 11.

A linker or linking group is a connection between two atoms that links one chemical group (such as an RNAi agent) or segment of interest to another chemical group (such as a targeting group, pharmacokinetic modulator, or delivery polymer) or segment of interest via one or more covalent bonds. A labile linkage contains a labile bond. A linkage can optionally include a spacer that increases the distance between the two joined atoms. A spacer may further add flexibility and/or length to the linkage. Spacers include, but are not limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description. In some embodiments, an ALK7 RNAi agent is conjugated to a polyethylene glycol (PEG) moiety, or to a hydrophobic group having 12 or more carbon atoms, such as a cholesterol or palmitoyl group.

In some embodiments, an ALK7 RNAi agent is linked to one or more lipid PK/PD moieties (referred to herein as "lipid moieties" or "PK/PD modulators".) Lipid PK/PD moieties may enhance the pharmacodynamic or pharmacokinetic properties of the RNAi agent. In some embodiments, the lipid moiety may be conjugated to a linker at the 3' or 5' end of a sense strand or an antisense strand of an RNAi agent described herein. In some embodiments, a lipid moiety may be linked at both the 3' or 5' end of either the sense strand or the antisense strand of an RNAi agent described herein.

In some embodiments, a lipid moiety may be conjugated to an ALK7 RNAi agent by reacting an ALK7 RNAi agent comprising an amine-comprising linker, for example, (NH2-C6) (see table 11). In some embodiments, the amine-comprising linker may be located on the 5' end of the sense strand or the antisense strand of an ALK7 RNAi agent. In some embodiments, the amine-comprising linker may be located on the 3' end of the sense strand or the antisense strand of an RNAi agent.

In some embodiments, an RNAi agent comprising an amine-comprising linker, such as (NH2-C6) or (NH2-C6) s, may be reacted with a lipid comprising an activated ester moiety.

In some embodiments, an RNAi agent comprising a disulfide linker, such as C6-SS—C6, may be reacted with a lipid comprising an aromatic sulfone, such as LP-371-p.

In some embodiments, an RNAi agent comprising an alkyne linker, such as L6-p, may be reacted with a lipid comprising an azide, such as LP-379-p. The lipid may be reacted with L6 to form a triazole before or after an amidation reaction with an amine such as NH2-C6.

In some embodiments, an ALK7 RNAi agent may be conjugated to a lipid moiety using phosphoramidite synthesis. Synthesizing oligonucleotides using phosphoramidites is well-known in the art. In some embodiments, a lipid moiety may be conjugated to the 5' end of the sense strand or the antisense strand of an ALK7 RNAi agent using a phosphoramidite. In some embodiments, a lipid moiety may be conjugated to the 3' end of the sense strand or the antisense strand of an ALK7 RNAi agent using a phosphoramidite.

In some embodiments, ALK7 RNAi agents may comprise a lipid moiety on an internal nucleotide (i.e., not on the 3' or 5' terminal nucleotides.) In some embodiments, a lipid moiety on an internal nucleotide may be linked to the 2' position of ribose.

Any of the ALK7 RNAi agent nucleotide sequences listed in Tables 2, 3, 4, 5, 6, and 10, whether modified or unmodified, can contain 3' and/or 5' targeting group(s), linking group(s), and/or lipid PK/PD moieties. Any of the ALK7 RNAi agent sequences listed in Tables 3, 4, 5, 6, and 10, or are otherwise described herein, which contain a 3' or 5' targeting group, linking group, and/or lipid PK/PD moiety can alternatively contain no 3' or 5' targeting group, linking group, or lipid PK/PD moiety, or can contain a different 3' or 5' targeting group, linking group, or lipid PK/PD moiety including, but not limited to, those depicted in Table 11. Any of the ALK7 RNAi agent duplexes listed in Tables 7A, 7B, 8, 9A and 10, whether modified or unmodified, can further comprise a targeting group, linking group, or PK/PD moiety including, but not limited to, those depicted in Table 11, and the targeting group, linking group or PK/PD moiety can be attached to the 3' or 5' terminus of either the sense strand or the antisense strand of the ALK7 RNAi agent duplex.

Examples of certain modified nucleotides, capping moieties, lipid moieties, and linking groups are provided in Table 11.

TABLE 11

Structures Representing Various Modified Nucleotides, Capping Moieties, lipid PK/PD moieties and Linking Groups (wherein ⌇ indicates the point of connection)

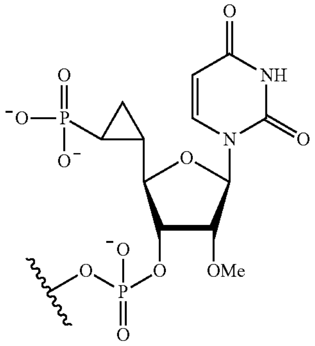

cPrpu

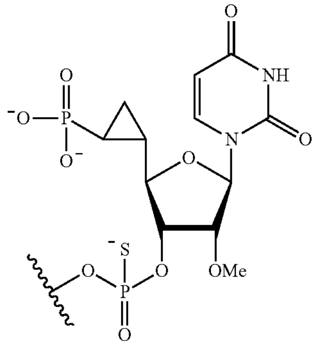

cPrpus

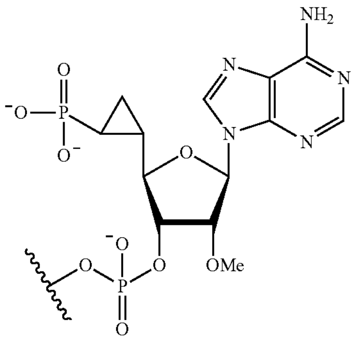

cPrpa

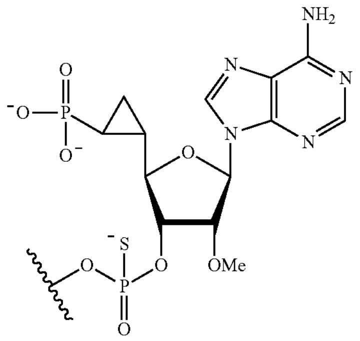

cPrpas

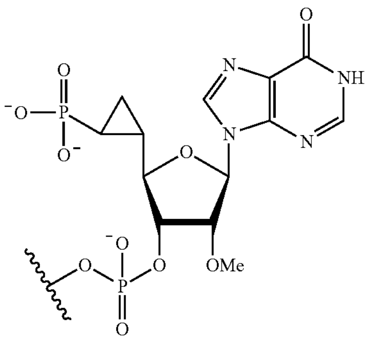

cPrpi

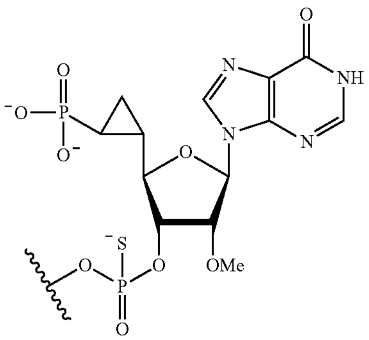

cPrpis

TABLE 11-continued

| Structures Representing Various Modified Nucleotides, Capping Moieties, lipid PK/PD moieties and Linking Groups (wherein ⌇ indicates the point of connection) | |
|---|---|
| 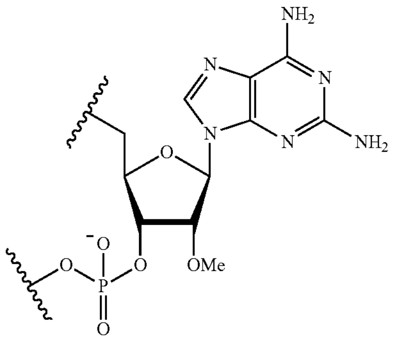<br>a_2N | 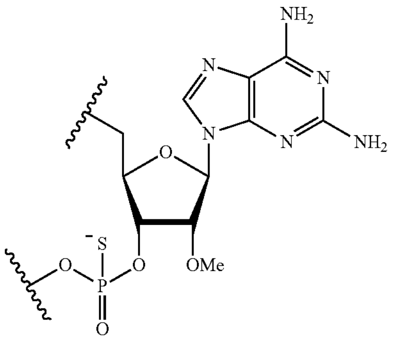<br>NL a_2Ns |
| When positioned internally: | |
| linkage towards 5′ end<br>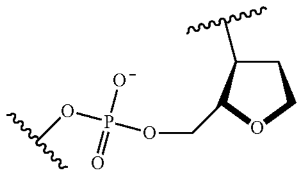<br>linkage towards 3′ end<br>(invAb) | linkage towards 5′ end<br>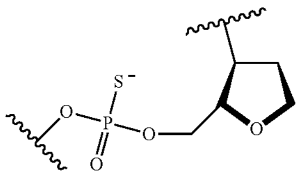<br>linkage towards 3′ end<br>(invAb)s |
| When positioned at the 3' terminal end: | |
| linkage towards 5′ end<br>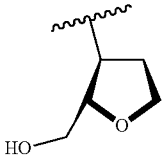<br>(invAb) | |
| When positioned at the 3' terminal end: | |
| linkage toward 5′ end<br>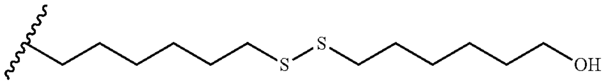<br>(C6-SS-C6) | |
| When positioned internally: | |
| linkage toward 5′ end linkage towards 3′ end<br>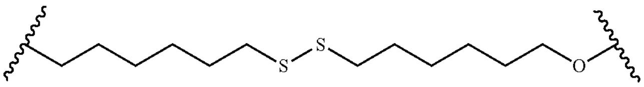<br>(C6-SS-C6) | |
| When positioned at the 3' terminal end: | |
| linkage toward 5′ end<br>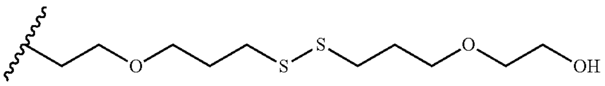<br>(6-SS-6) | |

TABLE 11-continued
| Structures Representing Various Modified Nucleotides, Capping Moieties, lipid PK/PD moieties and Linking Groups (wherein ⌇ indicates the point of connection) |
| --- |
| When positioned internally: |
linkage toward 5′ end linkage towards 3′ end
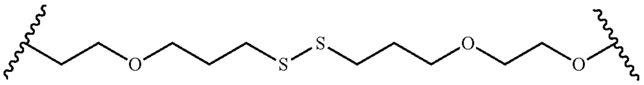
(6-SS-6)
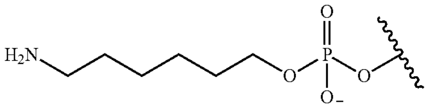 [SMILES: *OP(=O)([O-])OCCCCCCN]
(NH2-C6)
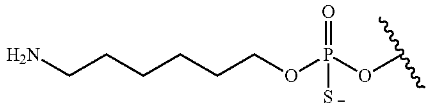
(NH2-C6)s
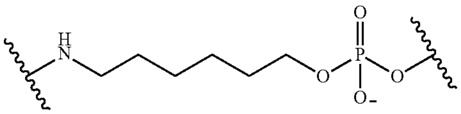 [SMILES: *NCCCCCCOP(=O)([O-])O*]
(NHC6)
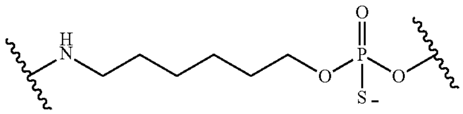
(NHC6)s
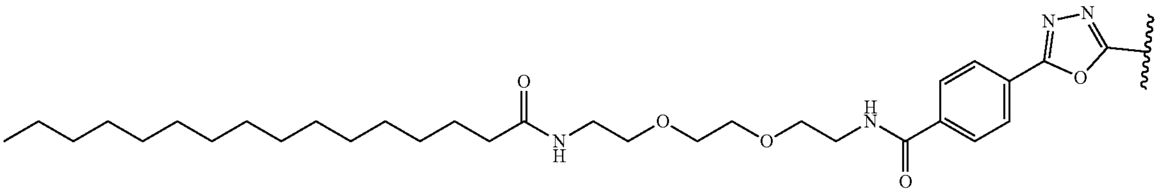 [SMILES: *c1nnc(-c2ccc(C(=O)NCCOCCOCCNC(=O)CCCCCCCCCCCCCCC)cc2)o1]
LP-371-a
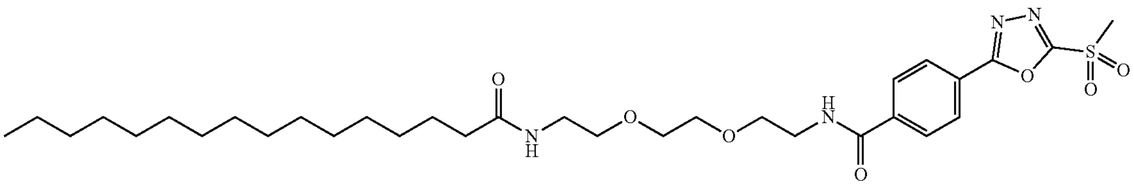 [SMILES: CCCCCCCCCCCCCCCC(=O)NCCOCCOCCNC(=O)c1ccc(-c2nnc(S(C)(=O)=O)o2)cc1]
LP-371-p
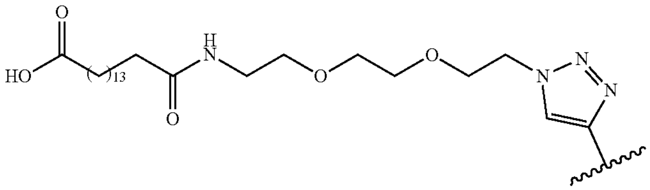
LP-379-a
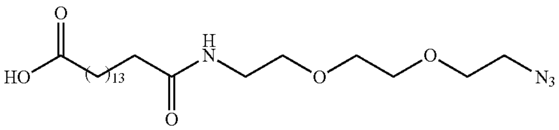
LP-379-p
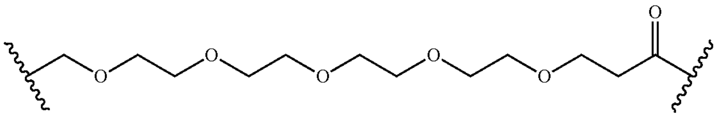 [SMILES: *COCCOCCOCCOCCOCCC(*)=O]
L6

TABLE 11-continued
Structures Representing Various Modified Nucleotides, Capping Moieties, lipid PK/PD moieties and Linking Groups (wherein ⌇ indicates the point of connection)
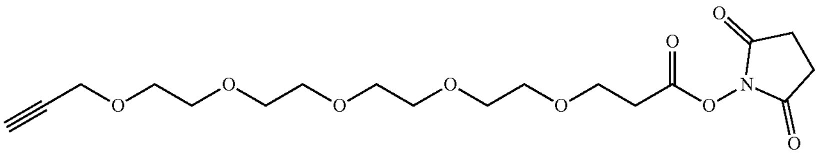 [SMILES: C#CCOCCOCCOCCOCCOCCC(=O)ON1C(=O)CCC1=O]
L6-p
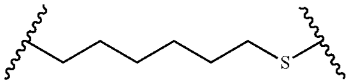 [SMILES: *CCCCCCS*]
(C6-S)
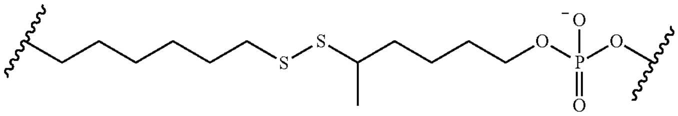 [SMILES: *CCCCCCSSC(C)CCCCOP(=O)([O-])O*]
(C6-SS-MeC5)
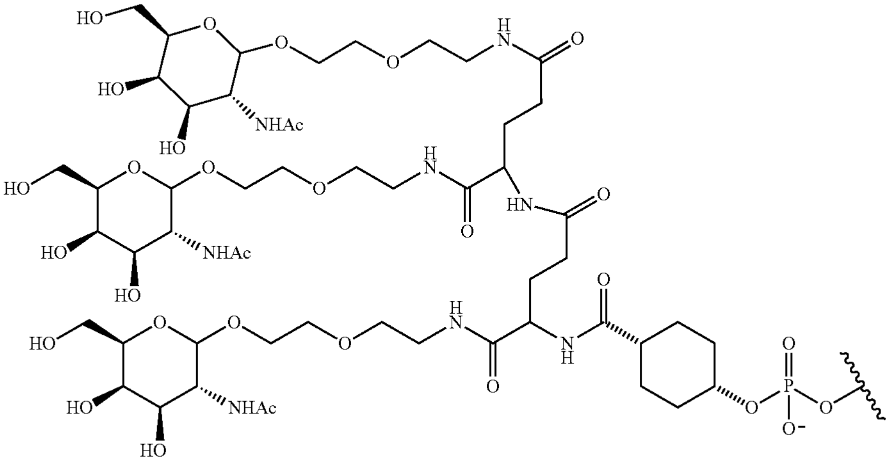 [SMILES: *OP(=O)([S-])O[C@H]1CC[C@@H](C(=O)NC(CCC(=O)NC(CCC(=O)NCCOCCOC2O[C@H](CO)[C@H](O)[C@H](O)[C@H]2NC(C)=O)C(=O)NCCOCCOC2O[C@H](CO)[C@H](O)[C@H](O)[C@H]2NC(C)=O)C(=O)NCCOCCOC2O[C@H](CO)[C@H](O)[C@H](O)[C@H]2NC(C)=O)CC1]
(NAG37)
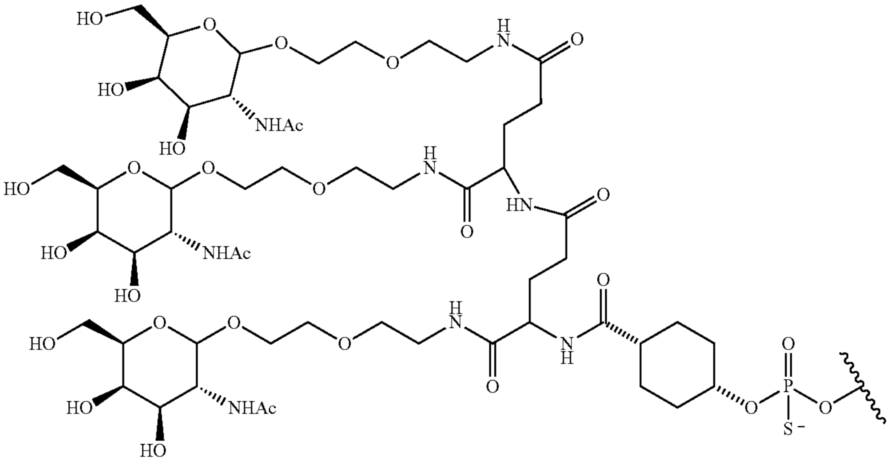
(NAG37)s TABLE 11-continued Structures Representing Various Modified Nucleotides, Capping Moieties, lipid PK/PD moieties and Linking Groups (wherein ⌇ indicates the point of connection)

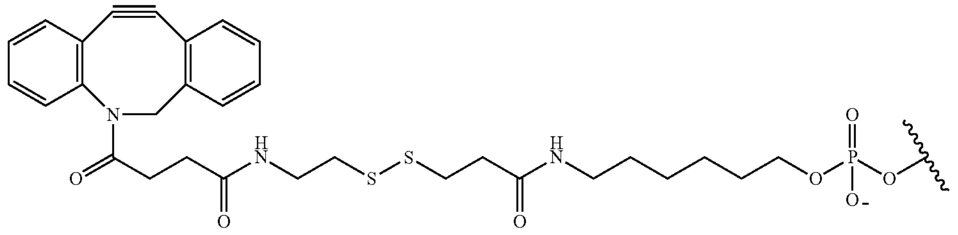 [SMILES: *OP(=O)([O-])OCCCCCCNC(=O)CCSSCCNC(=O)CCC(=O)N1Cc2ccccc2C#Cc2ccccc21]

(Alk-SS-C6)

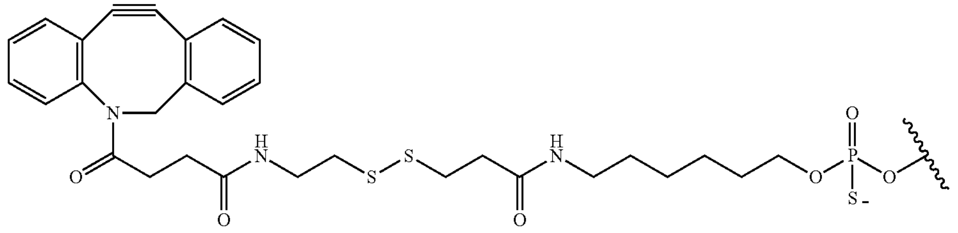 [SMILES: *OP(=O)([S-])OCCCCCCNC(=O)CCSSCCNC(=O)CCC(=O)N1Cc2ccccc2C#Cc2ccccc21]

(Alk-SS-C6)s

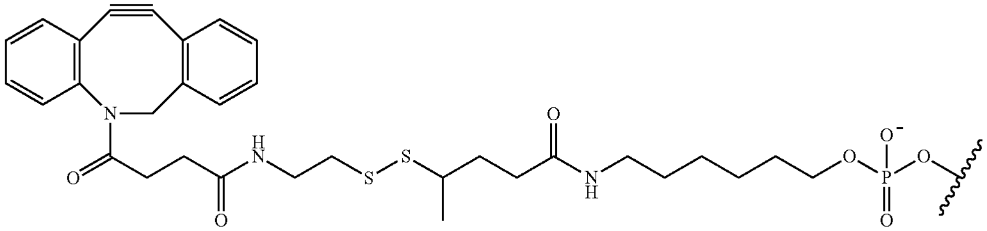 [SMILES: *OP(=O)([O-])OCCCCCCNC(=O)CCC(C)SSCCNC(=O)CCC(=O)N1Cc2ccccc2C#Cc2ccccc21]

(C6-SS-Alk-Me)

Alternatively, other linking groups known in the art may be used. In many instances, linking groups can be commercially acquired or alternatively, are incorporated into commercially available nucleotide phosphoramidites. (See, e.g., International Patent Application Publication No. WO 2019/161213, which is incorporated herein by reference in its entirety).

To evaluate the activity of ALK7 RNAi agents in a ALK7-AAV model as described in the Examples below, certain ALK7 RNAi agents were conjugated to an N-acetyl-galactosamine (NAG) containing targeting ligand having the chemical structure referred to as NAG37 (see Table 11). NAG37 is known to have high affinity to bind to asialoglycoprotein receptors that are abundantly expressed on liver cells, including hepatocytes (see, e.g., International Patent Application Publication No. WO2018044350A1). The use of NAG37-conjugated ALK7 RNAi agents was to evaluate the expression of AAV-ALK7 in the liver.

In some embodiments, an ALK7 RNAi agent is delivered without being conjugated to a targeting ligand or pharmacokinetic/pharmacodynamic (PK/PD) modulator (referred to as being "naked" or a "naked RNAi agent").

In some embodiments, an ALK7 RNAi agent is conjugated to a targeting group, a linking group, a PK modulator, and/or another non-nucleotide group to facilitate delivery of the ALK7 RNAi agent to the cell or tissue of choice, for example, to adipose tissue in vivo. In some embodiments, an ALK7 RNAi agent is conjugated to a lipid moiety.

In some embodiments, a delivery vehicle may be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine.

In some embodiments, the RNAi agents can be combined with lipids, nanoparticles, polymers, liposomes, micelles, DPCs or other delivery systems available in the art for nucleic acid delivery. The RNAi agents can also be chemically conjugated to targeting groups, lipids (including, but not limited to cholesteryl and cholesteryl derivatives), encapsulating in nanoparticles, liposomes, micelles, conjugating to polymers or DPCs (see, for example WO 2000/053722, WO 2008/022309, WO 2011/104169, and WO 2012/083185, WO 2013/032829, WO 2013/158141, each of which is incorporated herein by reference), by iontophoresis, or by incorporation into other delivery vehicles or systems available in the art such as hydrogels, cyclodextrins, biodegradable nanocapsules, bioadhesive microspheres, or proteinaceous vectors. In some embodiments the RNAi agents can be conjugated to antibodies having affinity for adipocyte cells. In some embodiments, the RNAi agents can be linked to targeting ligands that have affinity for cells in adipose tissue, for example adipocyte cells or receptors present on adipocyte cells.

Pharmaceutical Compositions and Formulations

The ALK7 RNAi agents disclosed herein can be prepared as pharmaceutical compositions or formulations (also referred to herein as "medicaments"). In some embodiments, pharmaceutical compositions include at least one ALK7 RNAi agent. These pharmaceutical compositions are particularly useful in the inhibition of the expression of ALK7 mRNA in a target cell, a group of cells, a tissue, or an organism. The pharmaceutical compositions can be used to treat a subject having a disease, disorder, or condition that would benefit from reduction in the level of the target mRNA, or inhibition in expression of the target gene. The pharmaceutical compositions can be used to treat a subject at risk of developing a disease or disorder that would benefit from reduction of the level of the target mRNA or an inhibition in expression the target gene. In one embodiment, the method includes administering an ALK7 RNAi agent linked to a PK/PD modulator as described herein, to a subject to be treated. In some embodiments, one or more pharmaceutically acceptable excipients (including vehicles, carriers, diluents, and/or delivery polymers) are added to the pharmaceutical compositions that include an ALK7 RNAi agent, thereby forming a pharmaceutical formulation or medicament suitable for in vivo delivery to a subject, including a human.

The pharmaceutical compositions that include an ALK7 RNAi agent and methods disclosed herein decrease the level of the target mRNA in a cell, group of cells, tissue, organ, or subject, including by administering to the subject a therapeutically effective amount of a herein described ALK7 RNAi agent, thereby inhibiting the expression of ALK7 mRNA in the subject. In some embodiments, the subject has been previously identified or diagnosed as having a disease or disorder that can be mediated at least in part by a reduction in ALK7 gene expression. In some embodiments, the subject has been previously diagnosed with having one or more metabolic diseases such as obesity, diabetes, or insulin resistance.

In some embodiments the subject has been previously diagnosed with having obesity, diabetes, or insulin resistance.

Embodiments of the present disclosure include pharmaceutical compositions for delivering an ALK7 RNAi agent to adipose tissue in vivo. Such pharmaceutical compositions can include, for example, an ALK7 RNAi agent conjugated to a lipid moiety.

In some embodiments, the described pharmaceutical compositions including an ALK7 RNAi agent are used for treating or managing clinical presentations in a subject that would benefit from the inhibition of expression of ALK7. In some embodiments, a therapeutically or prophylactically effective amount of one or more of pharmaceutical compositions is administered to a subject in need of such treatment. In some embodiments, administration of any of the disclosed ALK7 RNAi agents can be used to decrease the number, severity, and/or frequency of symptoms of a disease in a subject.

In some embodiments, the described ALK7 RNAi agents are optionally combined with one or more additional (i.e., second, third, etc.) therapeutics. A second therapeutic can be another ALK7 RNAi agent (e.g., an ALK7 RNAi agent that targets a different sequence within an ALK7 gene). In some embodiments, a second therapeutic can be an RNAi agent that targets the ALK7 gene. An additional therapeutic can also be a small molecule drug, antibody, antibody fragment, and/or aptamer. The ALK7 RNAi agents, with or without the one or more additional therapeutics, can be combined with one or more excipients to form pharmaceutical compositions.

The described pharmaceutical compositions that include an ALK7 RNAi agent can be used to treat at least one symptom in a subject having a disease or disorder that would benefit from reduction or inhibition in expression of ALK7 mRNA. In some embodiments, the subject is administered a therapeutically effective amount of one or more pharmaceutical compositions that include an ALK7 RNAi agent thereby treating the symptom. In other embodiments, the subject is administered a prophylactically effective amount of one or more ALK7 RNAi agents, thereby preventing or inhibiting the at least one symptom.

In some embodiments, one or more of the described ALK7 RNAi agents are administered to a mammal in a pharmaceutically acceptable carrier or diluent. In some embodiments, the mammal is a human.

The route of administration is the path by which an ALK7 RNAi agent is brought into contact with the body. In general, methods of administering drugs, oligonucleotides, and nucleic acids including the ALK7 RNAi agents described herein, for treatment of a mammal are well known in the art and can be applied to administration of the compositions described herein. The ALK7 RNAi agents disclosed herein can be administered via any suitable route in a preparation appropriately tailored to the particular route. Thus, in some embodiments, the herein described pharmaceutical compositions are administered via inhalation, intranasal administration, intratracheal administration, or oropharyngeal aspiration administration. In some embodiments, the pharmaceutical compositions can be administered by injection, for example, intravenously, intramuscularly, intracutaneously, subcutaneously, intracerebroventricularly, intraarticularly, intraocularly, or intraperitoneally, or topically.

The pharmaceutical compositions including an ALK7 RNAi agent described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with the compositions described herein. For example, delivery can be by local administration, (e.g., direct injection, implantation, or topical administering), systemic administration, or subcutaneous, intravenous, intraperitoneal, or parenteral routes, including intracranial (e.g., intraventricular, intraparenchymal and intrathecal), intracerebroventricular, intramuscular, transdermal, airway (aerosol), nasal, oral, rectal, or topical (including buccal and sublingual) administration. In some embodiments, the compositions are administered via inhalation, intranasal administration, oropharyngeal aspiration administration, or intratracheal administration. For example, in some embodiments, it is desired that the ALK7 RNAi agents described herein inhibit the expression of an ALK7 gene in adipose tissue.

In some embodiments, the pharmaceutical compositions described herein comprise one or more pharmaceutically acceptable excipients. The pharmaceutical compositions described herein are formulated for administration to a subject.

As used herein, a pharmaceutical composition or medicament includes a pharmacologically effective amount of at least one of the described therapeutic compounds and one or more pharmaceutically acceptable excipients. Pharmaceutically acceptable excipients (excipients) are substances other than the Active Pharmaceutical Ingredient (API, therapeutic product, e.g., ALK7 RNAi agent) that are intentionally included in the drug delivery system. Excipients do not exert or are not intended to exert a therapeutic effect at the intended dosage. Excipients can act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, buffering agents, carriers, coating agents, colors, delivery enhancers, delivery polymers, detergents, dextran, dextrose, diluents, disintegrants, emulsifiers, extenders, fillers, flavors, glidants, humectants, lubricants, oils, polymers, preservatives, saline, salts, solvents, sugars, surfactants, suspending agents, sustained release matrices, sweeteners, thickening agents, tonicity agents, vehicles, water-repelling agents, and wetting agents.

Pharmaceutical compositions suitable for injectable use include sterile aqueous solutions (where water-soluble) or dispersions and sterile powders for the extemporaneous preparation of sterile injectable solutions or dispersion. For intravenous administration, suitable carriers include physiological saline, bacteriostatic water, Cremophor® EL™ (BASF, Parsippany, NJ) or phosphate buffered saline (PBS). It should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyethylene glycol), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filter sterilization. Generally, dispersions are prepared by incorporating the active compound into a sterile vehicle which contains a basic dispersion medium and the required other ingredients from those enumerated above. In the case of sterile powders for the preparation of sterile injectable solutions, methods of preparation include vacuum drying and freeze-drying which yields a powder of the active ingredient plus any additional desired ingredient from a previously sterile-filtered solution thereof.

Formulations suitable for intra-articular administration can be in the form of a sterile aqueous preparation of the drug that can be in microcrystalline form, for example, in the form of an aqueous microcrystalline suspension. Liposomal formulations or biodegradable polymer systems can also be used to present the drug for both intra-articular and ophthalmic administration.

The active compounds can be prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Liposomal suspensions can also be used as pharmaceutically acceptable carriers. These can be prepared according to methods known to those skilled in the art, for example, as described in U.S. Pat. No. 4,522,811.

The ALK7 RNAi agents can be formulated in compositions in dosage unit form for ease of administration and uniformity of dosage. Dosage unit form refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the therapeutic effect to be achieved, and the limitations inherent in the art of compounding such an active compound for the treatment of individuals.

A pharmaceutical composition can contain other additional components commonly found in pharmaceutical compositions. Such additional components include, but are not limited to: anti-pruritics, astringents, local anesthetics, or anti-inflammatory agents (e.g., antihistamine, diphenhydramine, etc.). It is also envisioned that cells, tissues, or isolated organs that express or comprise the herein defined RNAi agents may be used as "pharmaceutical compositions." As used herein, "pharmacologically effective amount," "therapeutically effective amount," or simply "effective amount" refers to that amount of an RNAi agent to produce a pharmacological, therapeutic, or preventive result.

In some embodiments, ALK7 RNAi agent pharmaceutical compositions may contain salts such as sodium chloride, calcium chloride, magnesium chloride, potassium chloride, sodium phosphate dibasic, sodium phosphate monobasic, or combinations thereof.

In some embodiments, the methods disclosed herein further comprise the step of administering a second therapeutic or treatment in addition to administering an RNAi agent disclosed herein. In some embodiments, the second therapeutic is another ALK7 RNAi agent (e.g., an ALK7 RNAi agent that targets a different sequence within the ALK7 target). In other embodiments, the second therapeutic can be a small molecule drug, an antibody, an antibody fragment, and/or an aptamer.

In some embodiments, described herein are compositions that include a combination or cocktail of at least two ALK7 RNAi agents having different sequences. In some embodiments, the two or more ALK7 RNAi agents are each separately and independently linked to lipids.

Described herein are compositions for delivery of ALK7 RNAi agents to adipose tissue. Furthermore, compositions for delivery of ALK7 RNAi agents to adipose tissue, in vivo, are generally described herein.

Generally, an effective amount of an ALK7 RNAi agent disclosed herein will be in the range of from about 0.0001 to about 20 mg/kg of body weight dose, e.g., from about 0.001 to about 5 mg/kg of body weight dose. In some embodiments, an effective amount of an ALK7 RNAi agent will be in the range of from about 0.01 mg/kg to about 3.0 mg/kg of body weight per dose. In some embodiments, an effective amount of an ALK7 RNAi agent will be in the range of from about 0.03 mg/kg to about 2.0 mg/kg of body weight per dose. In some embodiments, an effective amount of an ALK7 RNAi agent will be in the range of from about 0.01 to about 1.0 mg/kg. In some embodiments, an effective amount of an ALK7 RNAi agent will be in the range of from about 0.50 to about 1.0 mg/kg. In some embodiments, a fixed dose of ALK7 RNAi agent is administered to the subject. In some embodiments the dose administered to the human subject is between about 1.0 mg and about 750 mg. In some embodiments, the dose of ALK7 RNAi agent administered to the human subject is between about 10 mg and about 450 mg. In some embodiments, the dose of ALK7 RNAi agent administered to the human subject is between about 25 mg and about 450 mg. In some embodiments, the dose of ALK7 RNAi agent administered to the human subject is about 50 mg, about 75 mg, about 100 mg, about 150 mg, about 200 mg, about 250 mg, about 300 mg, about 350 mg, about 400 mg, or about 450 mg. The amount administered will also likely depend on such variables as the overall health status of the patient, the relative biological efficacy of the compound delivered, the formulation of the drug, the presence and types of excipients in the formulation, and the route of administration. Also, it is to be understood that the initial dosage administered can be increased beyond the above upper level to rapidly achieve the desired blood-level or tissue level, or the initial dosage can be smaller than the optimum. In some embodiments, a dose is administered daily. In some embodiments, a dose is administered weekly. In further embodiments, a dose is administered bi-weekly, tri-weekly, once monthly, or once quarterly (i.e., once every three months).

For treatment of disease or for formation of a medicament or composition for treatment of a disease, the pharmaceutical compositions described herein including an ALK7 RNAi agent can be combined with an excipient or with a second therapeutic agent or treatment including, but not limited to: a second or other RNAi agent, a small molecule drug, an antibody, an antibody fragment, peptide, and/or an aptamer.

The described ALK7 RNAi agents, when added to pharmaceutically acceptable excipients or adjuvants, can be packaged into kits, containers, packs, or dispensers.

Methods of Treatment and Inhibition of ALK7 Gene Expression

The ALK7 RNAi agents disclosed herein can be used to treat a subject (e.g., a human or other mammal) having a disease or disorder that would benefit from administration of the RNAi agent. In some embodiments, the RNAi agents disclosed herein can be used to treat a subject (e.g., a human) that would benefit from a reduction and/or inhibition in expression of ALK7 mRNA and/or a reduction in ALK7 protein levels.

In some embodiments, the RNAi agents disclosed herein can be used to treat a subject (e.g., a human) having a disease or disorder for which the subject would benefit from reduction in ALK7 protein, including but not limited to, obesity, diabetes, or insulin resistance. Treatment of a subject can include therapeutic and/or prophylactic treatment. The subject is administered a therapeutically effective amount of any one or more ALK7 RNAi agents described herein. The subject can be a human, patient, or human patient. The subject may be an adult, adolescent, child, or infant. Administration of a pharmaceutical composition described herein can be to a human being or animal.

ALK7 activity is known to play a role in metabolic disorders. In some embodiments, the described ALK7 RNAi agents are used to treat at least one symptom mediated at least in part by a reduction in ALK7 protein levels, in a subject. The subject is administered a therapeutically effective amount of any one or more of the described ALK7 RNAi agents. In some embodiments, the subject is administered a prophylactically effective amount of any one or more of the described RNAi agents, thereby treating the subject by preventing or inhibiting the at least one symptom.

In certain embodiments, the present disclosure provides methods for treatment of diseases, disorders, conditions, or pathological states mediated at least in part by ALK7 gene expression, in a patient in need thereof, wherein the methods include administering to the patient any of the ALK7 RNAi agents described herein.

In some embodiments, the ALK7 RNAi agents are used to treat or manage a clinical presentation or pathological state in a subject, wherein the clinical presentation or pathological state is mediated at least in part by a reduction in ALK7 gene expression. The subject is administered a therapeutically effective amount of one or more of the ALK7 RNAi agents or ALK7 RNAi agent-containing compositions described herein. In some embodiments, the method comprises administering a composition comprising an ALK7 RNAi agent described herein to a subject to be treated.

In a further aspect, the disclosure features methods of treatment (including prophylactic or preventative treatment) of diseases or symptoms that may be addressed by a reduction in ALK7 protein levels, the methods comprising administering to a subject in need thereof an ALK7 RNAi agent that includes an antisense strand comprising the sequence of any of the sequences in Table 2, Table 3, or Table 10. Also described herein are compositions for use in such methods.

The described ALK7 RNAi agents and/or compositions that include ALK7 RNAi agents can be used in methods for therapeutic treatment of disease or conditions caused by enhanced or elevated ALK7 protein levels. Such methods include administration of an ALK7 RNAi agent as described herein to a subject, e.g., a human or animal subject.

In another aspect, the disclosure provides methods for the treatment (including prophylactic treatment) of a pathological state (such as a condition or disease) mediated at least in part by ALK7 gene expression, wherein the methods include administering to a subject a therapeutically effective amount of an RNAi agent that includes an antisense strand comprising the sequence of any of the sequences in Table 2, Table 3, or Table 10.

In some embodiments, methods for inhibiting expression of an ALK7 gene are disclosed herein, wherein the methods include administering to a cell an RNAi agent that includes an antisense strand comprising the sequence of any of the sequences in Table 2, Table 3, or Table 10.

In some embodiments, methods for the treatment (including prophylactic treatment) of a pathological state mediated at least in part by ALK7 gene expression are disclosed herein, wherein the methods include administering to a subject a therapeutically effective amount of an RNAi agent that includes a sense strand comprising the sequence of any of the sequences in Table 2, Table 4, Table 5, Table 6, Table 6a, or Table 10.

In some embodiments, methods for inhibiting expression of an ALK7 gene are disclosed herein, wherein the methods comprise administering to a cell an RNAi agent that includes a sense strand comprising the sequence of any of the sequences in Table 2, Table 4, Table 5, Table 6, Table 6a, or Table 10.

In some embodiments, methods for the treatment (including prophylactic treatment) of a pathological state mediated at least in part by ALK7 gene expression are disclosed herein, wherein the methods include administering to a subject a therapeutically effective amount of an RNAi agent that includes a sense strand comprising the sequence of any of the sequences in Table 4, Table 5, Table 6, Table 6a, or Table 10, and an antisense strand comprising the sequence of any of the sequences in Table 3 or Table 10.

In some embodiments, methods for inhibiting expression of an ALK7 gene are disclosed herein, wherein the methods include administering to a cell an RNAi agent that includes a sense strand comprising the sequence of any of the sequences in Table 4, Table 5, Table 6, Table 6a, or Table 10, and an antisense strand comprising the sequence of any of the sequences in Table 3 or Table 10.

In some embodiments, methods of inhibiting expression of an ALK7 gene are disclosed herein, wherein the methods include administering to a subject an ALK7 RNAi agent that includes a sense strand consisting of the nucleobase sequence of any of the sequences in Table 4, Table 5, Table 6, Table 6a, or Table 10, and the antisense strand consisting of the nucleobase sequence of any of the sequences in Table 3 or Table 10. In other embodiments, disclosed herein are methods of inhibiting expression of an ALK7 gene, wherein the methods include administering to a subject an ALK7 RNAi agent that includes a sense strand consisting of the modified sequence of any of the modified sequences in Table 4, Table 5, Table 6, Table 6a, or Table 10, and the antisense strand consisting of the modified sequence of any of the modified sequences in Table 3 or Table 10.

In some embodiments, methods for inhibiting expression of an ALK7 gene in a cell are disclosed herein, wherein the methods include administering one or more ALK7 RNAi agents comprising a duplex structure of one of the duplexes set forth in Tables 7A, 7B, 8, 9A, and 10.

In some embodiments, the gene expression level and/or mRNA level of an ALK7 gene in certain adipose tissues of subject to whom a described ALK7 RNAi agent is administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99%, relative to the subject prior to being administered the ALK7 RNAi agent or to a subject not receiving the ALK7 RNAi agent. In some embodiments, the ALK7 protein levels in certain adipose tissues of a subject to whom a described ALK7 RNAi agent is administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99%, relative to the subject prior to being administered the ALK7 RNAi agent or to a subject not receiving the ALK7 RNAi agent. The gene expression level, protein level, and/or mRNA level in the subject may be reduced in a cell, group of cells, and/or tissue of the subject. In some embodiments, the ALK7 mRNA levels in certain adipose tissues subject to whom a described ALK7 RNAi agent has been administered is reduced by at least about 30%, 35%, 40%, 45%, 50%, 55%, 60%, 65%, 70%, 75%, 80%, 85%, 90%, 95%, or 98% relative to the subject prior to being administered the ALK7 RNAi agent or to a subject not receiving the ALK7 RNAi agent.

A reduction in gene expression, mRNA, and protein levels can be assessed by any methods known in the art. Reduction or decrease in ALK7 protein levels are collectively referred to herein as a decrease in, reduction of, or inhibition of ALK7 expression. The Examples set forth herein illustrate known methods for assessing inhibition of ALK7 gene expression, including but not limited to determining ALK7 protein levels.

Cells, Tissues, Organs, and Non-Human Organisms

Cells, tissues, organs, and non-human organisms that include at least one of the ALK7 RNAi agents described herein are contemplated. The cell, tissue, organ, or non-human organism is made by delivering the RNAi agent to the cell, tissue, organ, or non-human organism.

ADDITIONAL ILLUSTRATIVE EMBODIMENTS

Provided here are certain additional illustrative embodiments of the disclosed technology. These embodiments are illustrative only and do not limit the scope of the present disclosure or of the claims attached hereto.

Embodiment 1. An RNAi agent for inhibiting expression of a Activin Receptor-Like Kinase 7 (ALK7) gene, comprising:
- an antisense strand comprising at least 17 contiguous nucleotides differing by 0 or 1 nucleotides from any one of the sequences provided in Table 2 or Table 3; and
- a sense strand comprising a nucleotide sequence that is at least partially complementary to the antisense strand.

Embodiment 2. The RNAi agent of embodiment 1, wherein the antisense strand comprises nucleotides 2-18 of any one of the sequences provided in Table 2 or Table 3.

Embodiment 3. The RNAi agent of embodiment 1 or embodiment 2, wherein the sense strand comprises a nucleotide sequence of at least 17 contiguous nucleotides differing by 0 or 1 nucleotides from any one of the sequences provided in Table 2 or Table 4, and wherein the sense strand has a region of at least 85% complementarity over the 17 contiguous nucleotides to the antisense strand.

Embodiment 4. The RNAi agent of any one of embodiments 1-3, wherein at least one nucleotide of the ALK7 RNAi agent is a modified nucleotide or includes a modified internucleoside linkage.

Embodiment 5. The RNAi agent of any one of embodiments 1-4, wherein all or substantially all of the nucleotides are modified nucleotides.

Embodiment 6. The RNAi agent of any one of embodiments 4-5, wherein the modified nucleotide is selected from the group consisting of: 2'-O-methyl nucleotide, 2'-fluoro nucleotide, 2'-deoxy nucleotide, 2',3'-seco nucleotide mimic, locked nucleotide, 2'-F-arabino nucleotide, 2'-methoxyethyl nucleotide, abasic nucleotide, ribitol, inverted nucleotide, inverted 2'-O-methyl nucleotide, inverted 2'-deoxy nucleotide, 2'-amino-modified nucleotide, 2'-alkyl-modified nucleotide, morpholino nucleotide, vinyl phosphonate-containing nucleotide, cyclopropyl phosphonate-containing nucleotide, and 3'-O-methyl nucleotide.

Embodiment 7. The RNAi agent of embodiment 5, wherein all or substantially all of the nucleotides are modified with 2'-O-methyl nucleotides, 2'-fluoro nucleotides, or combinations thereof.

Embodiment 8. The RNAi agent of any one of embodiments 1-7, wherein the antisense strand comprises the nucleotide sequence of any one of the modified sequences provided in Table 3.

Embodiment 9. The RNAi agent of any one of embodiments 1-8, wherein the sense strand comprises the nucleotide sequence of any one of the modified sequences provided in Table 4.

Embodiment 10. The RNAi agent of embodiment 1, wherein the antisense strand comprises the nucleotide sequence of any one of the modified sequences provided in Table 3 and the sense strand comprises the nucleotide sequence of any one of the modified sequences provided in Table 4.

Embodiment 11. The RNAi agent of any one of embodiments 1-10, wherein the sense strand is between 18 and 30 nucleotides in length, and the antisense strand is between 18 and 30 nucleotides in length.

Embodiment 12. The RNAi agent of embodiment 11, wherein the sense strand and the antisense strand are each between 18 and 27 nucleotides in length.

Embodiment 13. The RNAi agent of embodiment 12, wherein the sense strand and the antisense strand are each between 18 and 24 nucleotides in length.

Embodiment 14. The RNAi agent of embodiment 13, wherein the sense strand and the antisense strand are each 21 nucleotides in length.

Embodiment 15. The RNAi agent of embodiment 14, wherein the RNAi agent has two blunt ends.

Embodiment 16. The RNAi agent of any one of embodiments 1-15, wherein the sense strand comprises one or two terminal caps.

Embodiment 17. The RNAi agent of any one of embodiments 1-16, wherein the sense strand comprises one or two inverted abasic residues.

Embodiment 18. The RNAi agent of embodiment 1, wherein the RNAi agent is comprised of a sense strand and an antisense strand that form a duplex having the structure of any one of the duplexes in Table 7A, Table 7B, Table 8, Table 9A, or Table 10.

Embodiment 19. The RNAi agent of embodiment 18, wherein all or substantially all of the nucleotides are modified nucleotides.

Embodiment 20. The RNAi agent of embodiment 1, comprising an antisense strand that consists of, consists essentially of, or comprises a nucleotide sequence that differs by 0 or 1 nucleotides from one of the following nucleotide sequences (5'→3'):

(SEQ ID NO: 558)
AUUGUUGGAACUAUGACAGAC;
or (SEQ ID NO: 569)
UUCGAUAGUGUUCAGUAUUGC;
or (SEQ ID NO: 571)
UGUAUCAUCAAGCAUUUCAGG.

Embodiment 21. The RNAi agent of embodiment 20, wherein the sense strand consists of, consists essentially of, or comprises a nucleotide sequence that differs by 0 or 1 nucleotides from one of the following nucleotide sequences (5'→3'):

(SEQ ID NO: 599)
GUCUGUCAUAGUUCCAACAAU;
or (SEQ ID NO: 610)
GCAAUACUGAACACUAUCGAA;
or (SEQ ID NO: 612)
CCUGAAAUGCUUGAUGAUACA.

Embodiment 22. The RNAi agent of embodiment 20 or 21, wherein all or substantially all of the nucleotides are modified nucleotides.

Embodiment 23. The RNAi agent of embodiment 1, comprising an antisense strand that comprises, consists of, or consists essentially of a modified nucleotide sequence that differs by 0 or 1 nucleotides from one of the following nucleotide sequences (5'→3'):

(SEQ ID NO: 269)
cPrpasUfsuguuGfgaacUfaUfgAfcagasc;

(SEQ ID NO: 339)
cPrpusUfscgAfuaguguUfcAfgUfauugssc;
or (SEQ ID NO: 282)
cPrpusGfsuaucAfucaaGfcAfuUfucagsg.

wherein a represents 2'-O-methyl adenosine, c represents 2'-O-methyl cytidine, g represents 2'-O-methyl guanosine, and u represent 2'-O-methyl uridine; Af represents 2'-fluoro adenosine, Cf represents 2'-fluoro cytidine, Gf represents 2'-fluoro guanosine, and Uf represents 2'-fluoro uridine; cPrpu represents a 5'-cyclopropyl phosphonate-2'-O-methyl uridine, cPrpa represents a 5'-cyclopropyl phosphonate-2'-O-methyl adenosine; s represents a phosphorothioate linkage, ss represents a phosphorodithioate linkage; and wherein all or substantially all of the nucleotides on the sense strand are modified nucleotides.

Embodiment 24. The RNAi agent of embodiment 1, wherein the sense strand comprises, consists of, or consists essentially of a modified nucleotide sequence that differs by 0 or 1 nucleotides from one of the following nucleotide sequences (5'→3'):

(SEQ ID NO: 364)
gucugucaUfAfGfuuccaacaau;

(SEQ ID NO: 425)
gcaauacuGfaAfcAfcuaucgaa;
or (SEQ ID NO: 429)
ccugaaAfuGfcUfugaugauaca.

wherein a represents 2'-O-methyl adenosine, c represents 2'-O-methyl cytidine, g represents 2'-O-methyl guanosine, and u represent 2'-O-methyl uridine; Af represents 2'-fluoro adenosine, Cf represents 2'-fluoro cytidine, Gf represents 2'-fluoro guanosine, and Uf represents 2'-fluoro uridine; and s represents a phosphorothioate linkage; and wherein all or substantially all of the nucleotides on the antisense strand are modified nucleotides.

Embodiment 25. The RNAi agent of any one of embodiments 20-24, wherein the sense strand further includes inverted abasic residues at the 3' terminal end of the nucleotide sequence, at the 5' end of the nucleotide sequence, or at both.

Embodiment 26. The RNAi agent of any one of embodiments 1-25, wherein the RNAi agent is linked to a lipid moiety.

Embodiment 27. The RNAi agent of embodiment 26, wherein the RNAi agent is linked to two or more lipid moieties.

Embodiment 28. The RNAi agent of embodiment 27, wherein each of the lipid moieties is independently selected from the group consisting of:

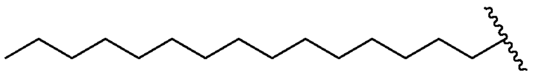

and

-continued

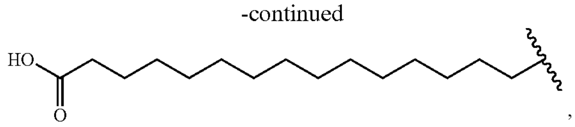

, wherein ⌇ indicates the point of connection to the RNAi agent.

Embodiment 29. The RNAi agent of any one of embodiments 26-28, wherein each of the lipid moieties is independently selected from the group consisting of:

Embodiment 40. The composition of any of embodiments 35-38, wherein the pharmaceutically acceptable excipient is a buffered saline solution.

Embodiment 41. The composition of any of embodiments 35-38, wherein the pharmaceutically acceptable excipient is sodium chloride.

Embodiment 42. A method for inhibiting expression of an ALK7 gene in a cell, the method comprising introducing into a cell an effective amount of an RNAi agent of any one of embodiments 1-34 or the composition of any one of embodiments 35-41.

LP-371-a

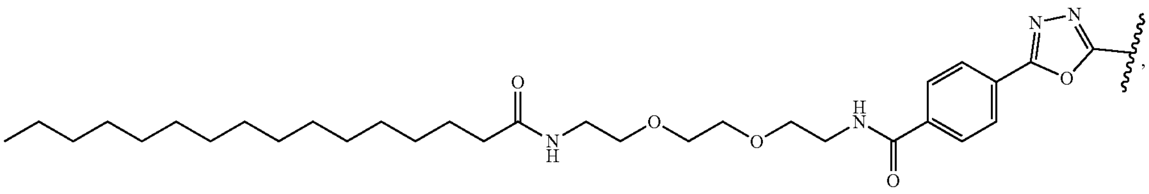

, and

LP-379-a

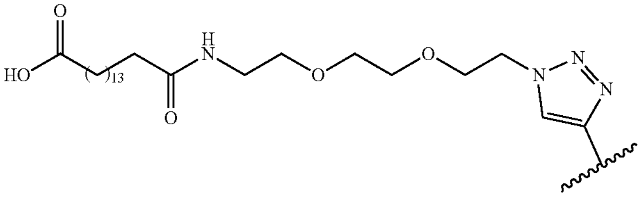

wherein ⌇ indicates the point of connection to the RNAi agent.

Embodiment 30. The RNAi agent of embodiment 26 or embodiment 27, wherein the lipid moiety is conjugated to the sense strand.

Embodiment 31. The RNAi agent of embodiment 26, wherein the RNAi agent is linked to LP-379-a on the 5' terminus of the sense strand, and linked to LP-371-a on the 3' terminus of the sense strand.

Embodiment 32. A composition comprising the RNAi agent of any one of embodiments 1-31, wherein the composition further comprises a pharmaceutically acceptable excipient.

Embodiment 33. The RNAi agent of embodiment 1, wherein the RNAi agent has a duplex structure of any one of the duplexes of Table 10.

Embodiment 34. The RNAi agent of embodiment 32, wherein the duplex structure is selected from the group consisting of: AC006188, AC006189, AC006648, AC006661, or AC006663.

Embodiment 35. The RNAi agent of embodiment 1, wherein the RNAi agent has the structure of any one of FIGS. 4A-4D to 13A-13D.

Embodiment 36. The composition of embodiment 35, further comprising a second RNAi agent capable of inhibiting the expression of Activin Receptor-Like Kinase 7 gene expression.

Embodiment 37. The composition of any one of embodiments 35-36, further comprising one or more additional therapeutics.

Embodiment 38. The composition of any of embodiments 35-37, wherein the RNAi agent is a sodium salt.

Embodiment 39. The composition of any of embodiments 35-37, wherein the pharmaceutically acceptable excipient is water for injection.

Embodiment 43. The method of embodiment 42, wherein the cell is within a subject.

Embodiment 44. The method of embodiment 43, wherein the subject is a human subject.

Embodiment 45. The method of any one of embodiments 42-44, wherein following the administration of the RNAi agent the Activin Receptor-Like Kinase 7 (ALK7) gene expression is inhibited by at least about 30%.

Embodiment 46. A method of treating one or more symptoms or diseases associated with enhanced or elevated ALK7 activity levels, the method comprising administering to a human subject in need thereof a therapeutically effective amount of the composition of any one of embodiments 35-41.

Embodiment 47. The method of embodiment 46, wherein the disease is a metabolic disease.

Embodiment 48. The method of embodiment 47, wherein the metabolic disease is obesity, diabetes, or insulin resistance.

Embodiment 49. The method of embodiment 46, wherein the disease is obesity, diabetes, or insulin resistance.

Embodiment 50. The method of embodiment 49, wherein the disease is obesity.

Embodiment 51. The method of any one of embodiments 42-50, wherein the RNAi agent is administered at a dose of about 0.01 mg/kg to about 5.0 mg/kg of body weight of the subject.

Embodiment 52. The method of any one of embodiments 42-51, wherein the RNAi agent is administered at a dose of about 0.03 mg/kg to about 2.0 mg/kg of body weight of the subject.

Embodiment 53. The method of any one of embodiments 42-50, wherein the RNAi agent is administered at a fixed dose of about 25 mg to about 450 mg.

Embodiment 54. The method of embodiment 53, wherein the RNAi agent is administered at a dose of about 25 mg, about 50 mg, about 150 mg, or about 450 mg.

Embodiment 55. The method of any of embodiments 42-54, wherein the RNAi agent is administered in two or more doses.

Embodiment 56. The method of any one of embodiments 43-55, wherein the subject is administered a second therapeutic.

Embodiment 57. The method of embodiment 56, wherein the second therapeutic is a glucagon-like peptide 1 (GLP1) agonist.

Embodiment 58. The method of embodiment 57, wherein the GLP1 agonist is tirzepatide.

Embodiment 59. Use of the RNAi agent of any one of embodiments 1-34, for the treatment of a disease, disorder, or symptom that is mediated at least in part by ALK7 activity and/or ALK7 gene expression.

Embodiment 60. Use of the composition according to any one of embodiments 35-41, for the treatment of a disease, disorder, or symptom that is mediated at least in part by Activin Receptor-Like Kinase 7 (ALK7) activity and/or Activin Receptor-Like Kinase 7 (ALK7) gene expression.

Embodiment 61. Use of the composition according to any one of embodiments 35-41, for the manufacture of a medicament for treatment of a disease, disorder, or symptom that is mediated at least in part by Activin Receptor-Like Kinase 7 (ALK7) and/or Activin Receptor-Like Kinase 7 (ALK7) gene expression.

Embodiment 62. The use of any one of embodiments 59-61, wherein the disease is a metabolic disease.

Embodiment 63. A method of making an RNAi agent of any one of embodiments 1-34, comprising annealing a sense strand and an antisense strand to form a double-stranded ribonucleic acid molecule.

Embodiment 64. The method of embodiment 63, wherein the sense strand comprises a lipid moiety.

Embodiment 65. The method of embodiment 64, comprising conjugating a lipid moiety to the sense strand.

EXAMPLES

Example 1. Synthesis of ALK7 RNAi Agents

ALK7 RNAi agent duplexes disclosed herein were synthesized in accordance with the following:

A. Synthesis.

The sense and antisense strands of the ALK7 RNAi agents were synthesized according to phosphoramidite technology on solid phase used in oligonucleotide synthesis. Depending on the scale, a MerMade96E® (Bioautomation), a MerMade12® (Bioautomation), or an OP Pilot 100 (GE Healthcare) was used. Syntheses were performed on a solid support made of controlled pore glass (CPG, 500 Å or 600 Å, obtained from Prime Synthesis, Aston, PA, USA). All RNA and 2'-modified RNA phosphoramidites were purchased from Thermo Fisher Scientific (Milwaukee, WI, USA). Specifically, the 2'-O-methyl phosphoramidites that were used included the following: (5'-O-dimethoxytrityl-$N^6$-(benzoyl)-2'-O-methyl-adenosine-3'-O-(2-cyanoethyl-N,N-diisopropylamino) phosphoramidite, 5'-O-dimethoxy-trityl-$N^4$-(acetyl)-2'-O-methyl-cytidine-3'-O-(2-cyanoethyl-N,N-diisopropylamino) phosphoramidite, (5'-O-dimethoxytrityl-$N^2$-(isobutyryl)-2'-O-methyl-guanosine-3'-O-(2-cyanoethyl-N,N-diisopropylamino) phosphoramidite, and 5'-O-dimethoxytrityl-2'-O-methyl-uridine-3'-O-(2-cyanoethyl-N,N-diisopropylamino) phosphoramidite. The 2'-deoxy-2'-fluoro-phosphoramidites carried the same protecting groups as the 2'-O-methyl RNA amidites. 5'-dimethoxytrityl-2'-O-methyl-inosine-3'-O-(2-cyanoethyl-N,N-diisopropylamino) phosphoramidites were purchased from Glen Research (Virginia). The inverted abasic (3'-O-dimethoxytrityl-2'-deoxyribose-5'-O-(2-cyanoethyl-N,N-diisopropylamino) phosphoramidites were purchased from ChemGenes (Wilmington, MA, USA). The following UNA phosphoramidites were used: 5'-(4,4'-Dimethoxytrityl)-N6-(benzoyl)-2',3'-seco-adenosine, 2'-benzoyl-3'-[(2-cyanoethyl)-(N,N-diisopropyl)]-phosphoramidite, 5'-(4,4'-Dimethoxytrityl)-N-acetyl-2',3'-seco-cytosine, 2'-benzoyl-3'-[(2-cyanoethyl)-(N,N-diiso-propyl)]-phosphoramidite, 5'-(4,4'-Dimethoxytrityl)-N-isobutyryl-2',3'-seco-guanosine, 2'-benzoyl-3'-[(2-cyanoethyl)-(N,N-diisopropyl)]-phosphoramidite, and 5'-(4,4'-Dimethoxy-trityl)-2',3'-seco-uridine, 2'-benzoyl-3'-[(2-cyanoethyl)-(N,N-diiso-propyl)]-phosphoramidite. TFA aminolink phosphoramidites were also commercially purchased (ThermoFisher). Linker L6 was purchased as propargyl-PEG5-NHS from BroadPharm (catalog #BP-20907) and coupled to the $NH_2$—$C_6$ group from an aminolink phosphoramidite to form-L6-(NHC6)-, using standard coupling conditions. The linker Alk-cyHex was similarly commercially purchased from Lumiprobe (alkyne phosphoramidite, 5'-terminal) as a propargyl-containing compound phosphoramidite compound to form the linker-Alk-cyHex-. In each case, phosphorothioate or phosphorodithioate linkages were introduced as specified using the conditions set forth herein. The cyclopropyl phosphonate phosphoramidites were synthesized in accordance with International Patent Application Publication No. WO 2017/214112 (see also Altenhofer et. al., Chem. Communications (Royal Soc. Chem.), 57 (55): 6808-6811 (July 2021)).

Tri-alkyne-containing phosphoramidites were dissolved in anhydrous dichloromethane or anhydrous acetonitrile (50 mM), while all other amidites were dissolved in anhydrous acetonitrile (50 mM) and molecular sieves (3 Å) were added. 5-Benzylthio-1H-tetrazole (BTT, 250 mM in acetonitrile) or 5-Ethylthio-1H-tetrazole (ETT, 250 mM in acetonitrile) was used as activator solution. Coupling times were 10 minutes (RNA), 90 seconds (2' O-Me), and 60 seconds (2' F). In order to introduce phosphorothioate linkages, a 100 mM solution of 3-phenyl 1,2,4-dithiazoline-5-one (POS, obtained from PolyOrg, Inc., Leominster, MA, USA) in anhydrous acetonitrile was employed.

Alternatively, tri-alkyne moieties were introduced post-synthetically (see section E, below). For this route, the sense strand was functionalized with a 5' and/or 3' terminal nucleotide containing a primary amine. TFA aminolink phosphoramidite was dissolved in anhydrous acetonitrile (50 mM) and molecular sieves (3 Å) were added. 5-Benzylthio-1H-tetrazole (BTT, 250 mM in acetonitrile) or 5-Ethylthio-1H-tetrazole (ETT, 250 mM in acetonitrile) was used as activator solution. Coupling times were 10 minutes (RNA), 90 seconds (2' O-Me), and 60 seconds (2' F). In order to introduce phosphorothioate linkages, a 100 mM solution of 3-phenyl 1,2,4-dithiazoline-5-one (POS, obtained from PolyOrg, Inc., Leominster, MA, USA) in anhydrous acetonitrile was employed.

B. Cleavage and Deprotection of Support Bound Oligomer.

After finalization of the solid phase synthesis, the dried solid support was treated with a 1:1 volume solution of 40 wt. % methylamine in water and 28% to 31% ammonium hydroxide solution (Aldrich) for 1.5 hours at 30° C. The solution was evaporated and the solid residue was reconstituted in water (see below).

C. Purification.

Crude oligomers were purified by anionic exchange HPLC using a TSKgel SuperQ-5 PW 13 μm column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC using a GE Healthcare XK 16/40 column packed with Sephadex G-25 fine with a running buffer of 100 mM ammonium bicarbonate, pH 6.7 and 20% Acetonitrile or filtered water. Alternatively, pooled fractions were desalted and exchanged into an appropriate buffer or solvent system via tangential flow filtration.

D. Annealing.

Complementary strands were mixed by combining equimolar RNA solutions (sense and antisense) in 1×PBS (Phosphate-Buffered Saline, 1×, Corning, Cellgro) to form the RNAi agents. Some RNAi agents were lyophilized and stored at −15 to −25° C. Duplex concentration was determined by measuring the solution absorbance on a UV-Vis spectrometer in 1×PBS. The solution absorbance at 260 nm was then multiplied by a conversion factor (0.050 mg/(mL·cm)) and the dilution factor to determine the duplex concentration.

E. Synthesis of Lipids

Synthesis of LP-379-p

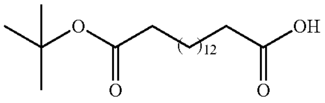

+

1

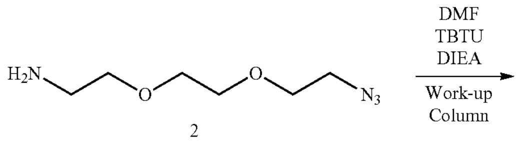

2

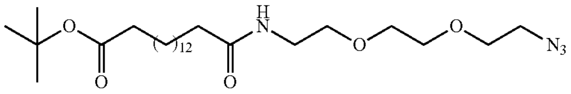

3

Compound 1 (Asta Tech® #89929, 3.00 g) was dissolved in 50 mL DMF. Then TBTU (3.09 g) and DIPEA (6.2 mL) were added and the mixture was stirred for 10 minutes. Compound 2 (1.68 g in DMF) was then added. The mixture was allowed to stir for 1 hour. Then the mixture was diluted with 300 mL EtOAc and washed with 3% citric acid (3×60 mL), $H_2O$ (2×60 mL), and NaCl (1×60 mL), dried over $Na_2SO_4$, filtered and concentrated on rotary evaporator and placed under high vacuum. The crude product was loaded onto 80 g column in 14 mL DCM with 2 drops MeOH and purified with flash chromatography (MeOH/DCM, 0-4% over 40 min.) Yield 4.033 g. LC-MS: calculated [M+H] 498.71, found 499.85.

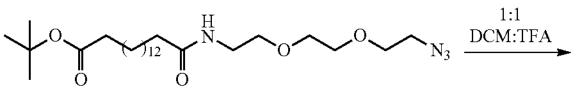

1

-continued

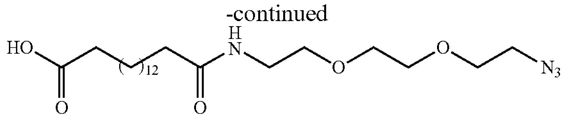

2

Compound 1 (4.033 g) was dissolved in 50 mL 1:1 DCM:TFA. The mixture was stirred for 1 hour. The product was concentrated on rotary evaporator and placed under high vacuum. The product was then dissolved in ACN, concentrated, then dissolved in DCM and concentrated again. Yield 3.839 g. LC-MS: calculated [M+H] 442.60, found 443.81.

Synthesis of LP-371-p

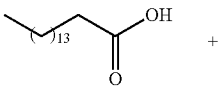

+

1

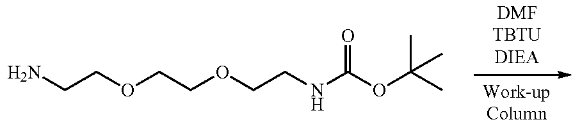

2

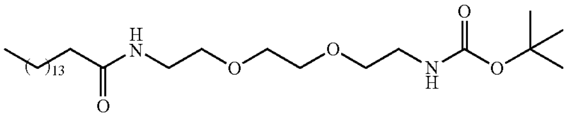

3

Compound 1 (palmitic acid, 2.50 g) was dissolved in 60 mL DMF. Then TBTU (3.44 g) and DIPEA (6.9 mL) were added. The reaction was stirred for 10 minutes then compound 2 (2.66 g in DMF) was added. The reaction was complete after 1 hour. The mixture was diluted with 300 mL EtOAc and washed with 3% citric acid (3×60 mL), $H_2O$ (2×60 mL), and NaCl (1×60 mL), then dried over $Na_2SO_4$. The product was filtered and concentrated on rotary evaporator and high vacuum. The product was purified using column chromatography (loaded in DCM (15 mL) with a drop of MeOH onto a 80G RediSep Gold Rf column, mobile phase MeOH/DCM, 0-5% over 30 minutes. Yield 4.094 g. LC-MS: calculated [M+H] 486.74, found 488.11.

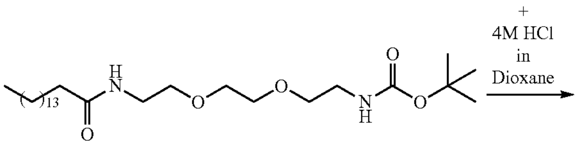

1

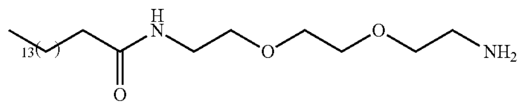

2

Compound 1 (4.094 g) was dissolved in 4M HCl in dioxane (28 mL) at 0° C. for 10 minutes. The reaction was allowed to warm to room temperature then stirred for 2 hours. The product was concentrated on rotary evaporator and high vacuum. Yield 3.485 g. LC-MS: calculated [M+H] 386.57, found 388.02.

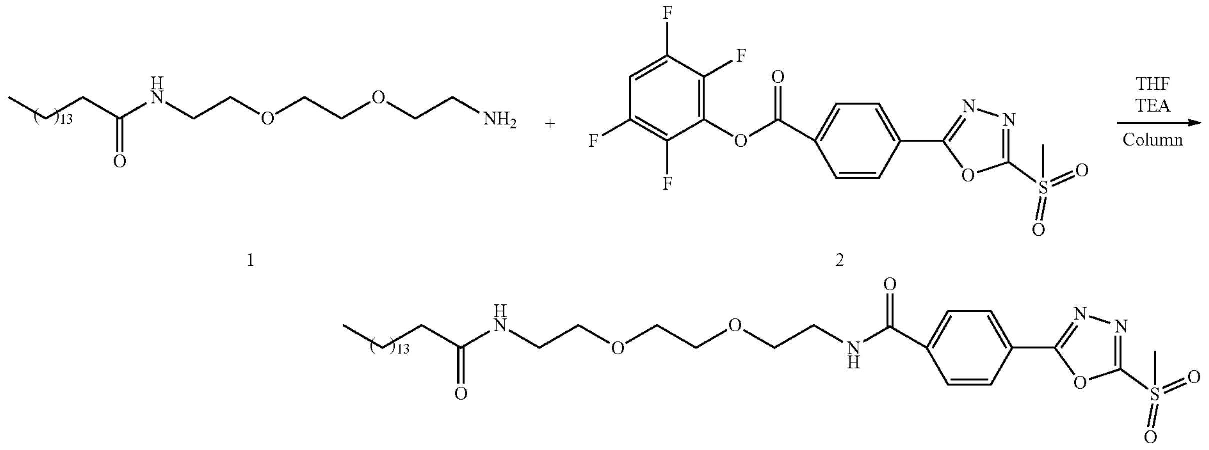

1 2

3

Compound 1 (2.3 g) was dissolved in 80 mL THF. Then TEA (4.975 mL) and compound 2 (3.10 g) were added. The reaction was stirred for 1 hour. The reaction was dry loaded with Celite 545, the mixture was concentrated in a 28° C. water bath and placed on high vacuum to fully dry. The product was purified with flash chromatography (MeOH/DCM, 0-6% over 40 min.) Yield 2.905 g. LC-MS: calculated [M+H] 636.85, found 637.95.

Linkers

Linker L6 was purchased as propargyl-PEG5-NHS from BroadPharm (catalog #BP-20907) and coupled to the $NH_2$—$C_6$ group from an aminolink phosphoramidite to form-L6-C6-, using standard coupling conditions.

Conjugation of Lipid PK/PD Modulator Precursors

Either prior to or after annealing, one or more lipid PK/PD modulator precursors can be linked to the RNAi agents disclosed herein. The following describes the general conjugation process used to link lipid PK/PD modulator precursors to the constructs set forth in the Examples depicted herein.

A. Conjugation of a Sulfone-Containing Lipid PK/PD Modulator Precursor

In a vial, functionalized sense strand was dissolved at 50 mg/mL in sterilized water. Then 20 equivalents of each of 0.1M Hepes pH 8.5 buffer and dithiothreitol are added. The mixture was allowed to react for one hour, then the conjugate was precipitated in acetonitrile and PBS, and the solids were centrifuged into a pellet.

The pellet was brought up in a 70/30 mixture of DMSO/water at a solids concentration of 30 mg/mL. Then, the sulfone-containing lipid PK/PD modulator precursor was added at 1.5 equivalents. The vial was purged with $N_2$, and heated to 40° C. while stirring. The mixture was allowed to react for one hour. The product was purified on an AEX-HPLC (mobile phase A: 25 mM TRIS pH=7.2, 1 mM EDTA, 50% acetonitrile; mobile phase B: 25 mM TRIS pH=7.2, 1 mM EDTA, 500 mM NaBr, 50% acetonitrile; solid phase TSKgel-30; 1.5 cm×10 cm.) The solvent was removed by rotary evaporator, and desalted with a 3K spin column using 2×10 mL exchanges with sterilized water. The solid product was dried using lyophilization and stored for later use.

B. Conjugation of an Azide-Containing Lipid PK/PD Modulator Precursor

One molar equivalent of TG-TBTA resin loaded with Cu(I) was weighed into a glass vial. The vial was purged with $N_2$ for 15 minutes. Then, functionalized sense strand was dissolved in a separate vial in sterilized water at a concentration of 100 mg/mL. Then two equivalents of the azide-containing lipid PK/PD modulator precursor (50 mg/mL in DMF) is added to the vial. Then TEA, DMF and water are added until the final reaction conditions are 33 mM TEA, 60% DMF, and 20 mg/mL of the conjugated product. The solution was then transferred to the vial with resin via a syringe. The $N_2$ purge was removed and the vial was sealed and moved to a stir plate at 40° C. The mixture was allowed to react for 16 hours. The resin was filtered off using a 0.45 μm filter.

The product was purified using AEX purification (mobile phase A: 25 mM TRIS pH=7.2, 1 mM EDTA, 50% acetonitrile; mobile phase B: 25 mM TRIS pH=7.2, 1 mM EDTA, 500 mM NaBr, 50% acetonitrile solid phase TSKgel-30; 1.5 cm×10 cm.) The acetonitrile was removed using a rotary evaporator, and desalted with a 3K spin column using 2×10 mL exchanges with sterilized water. The solid product was dried using lyophilization and stored for later use.

Example 2. In Vivo Administration of ALK7 RNAi Agents in Mice

ALK7 RNAi agents were evaluated in vivo in mice. On Day 1, five (n=5) female C57bl/6 mice in each group were given a single subcutaneous (SQ) injection of 250 μl per 25 g body weight containing either 1.0 mg/kg (mpk), 3.0 mg/kg (mpk) of an ALK7 RNAi agent, or saline. Dosing was in accordance with Table 12 below.

TABLE 12

Dosing groups for the mice of Example 2.

| Group ID | Dose (RNAi Agent) | # of Animals |
|---|---|---|
| 1. Saline | Day 1: Single SQ Injection | n = 5 |
| 2. 1.0 mg/kg AC004391 | Day 1: Single SQ Injection | n = 5 |
| 3. 3.0 mg/kg AC004391 | Day 1: Single SQ Injection | n = 5 |
| 4. 1.0 mg/kg AC004390 | Day 1: Single SQ Injection | n = 5 |
| 5. 3.0 mg/kg AC004390 | Day 1: Single SQ Injection | n = 5 |
| 6. 1.0 mg/kg AC004392 | Day 1: Single SQ Injection | n = 5 |
| 7. 3.0 mg/kg AC004392 | Day 1: Single SQ Injection | n = 5 |
| 8. 1.0 mg/kg AC005181 | Day 1: Single SQ Injection | n = 5 |
| 9. 3.0 mg/kg AC005181 | Day 1: Single SQ Injection | n = 5 |
| 10. 1.0 mg/kg AC005824 | Day 1: Single SQ Injection | n = 5 |

TABLE 12-continued

| Dosing groups for the mice of Example 2. | | |
|---|---|---|
| Group ID | Dose (RNAi Agent) | # of Animals |
| 11. 3.0 mg/kg AC005824 | Day 1: Single SQ Injection | n = 5 |
| 12. 1.0 mg/kg AC005823 | Day 1: Single SQ Injection | n = 5 |
| 13. 3.0 mg/kg AC005823 | Day 1: Single SQ Injection | n = 5 |

ALK7 RNAi agents AC004391, AC004390, AC004392, and AC005181 target and initiate RNAi and RNA-induced silencing complex (RISC) of mouse ALK7. ALK7 RNAi agents AC005824 and AC005823 target and initiate RNAi and RNA-induced silencing complex (RISC) of human ALK7.

Five (n=5) mice were dosed in each group. Mice were injected subcutaneously (SQ) on day 1. On day 15, mice were euthanized, and ~50 mg adipose tissues (inguinal white adipose tissue iWAT, perigonadal white adipose tissue pgWAT) were collected for analysis. Samples were analyzed by qPCR for mALK7 mRNA knockdown, using mARL1 as the endogenous control gene. Each group was normalized to group 1 (saline). Average results for each group are shown in Table 13 below.

TABLE 13

Relative expression of ALK7 mRNA in various tissues analyzed by qPCR for each of the dosing groups of Example 2.

| | iWAT Group Average (n = 5) | | | pgWAT Group Average (n = 5) | | |
|---|---|---|---|---|---|---|
| Group ID | Rel. Exp. | Error (Low) | Error (High) | Rel. Exp. | Error (Low) | Error (High) |
| 1. Saline | 1.000 | 0.111 | 0.124 | 1.000 | 0.144 | 0.168 |
| 2. 1.0 mg/kg AC004391 | 0.501 | 0.101 | 0.127 | 0.566 | 0.135 | 0.178 |
| 3. 3.0 mg/kg AC004391 | 0.504 | 0.085 | 0.103 | 0.503 | 0.097 | 0.121 |
| 4. 1.0 mg/kg AC004390 | 0.454 | 0.066 | 0.078 | 0.496 | 0.062 | 0.071 |
| 5. 3.0 mg/kg AC004390 | 0.339 | 0.097 | 0.137 | 0.394 | 0.142 | 0.223 |
| 6. 1.0 mg/kg AC004392 | 0.542 | 0.109 | 0.137 | 0.520 | 0.124 | 0.163 |
| 7. 3.0 mg/kg AC004392 | 0.376 | 0.095 | 0.127 | 0.542 | 0.125 | 0.163 |
| 8. 1.0 mg/kg AC005181 | 0.399 | 0.057 | 0.067 | 0.349 | 0.091 | 0.124 |
| 9. 3.0 mg/kg AC005181 | 0.337 | 0.069 | 0.087 | 0.187 | 0.063 | 0.096 |
| 10. 1.0 mg/kg AC005824 | 0.505 | 0.130 | 0.175 | 0.461 | 0.103 | 0.133 |
| 11. 3.0 mg/kg AC005824 | 0.294 | 0.039 | 0.044 | 0.347 | 0.062 | 0.075 |
| 12. 1.0 mg/kg AC005823 | 0.422 | 0.122 | 0.171 | 0.407 | 0.114 | 0.158 |
| 13. 3.0 mg/kg AC005823 | 0.345 | 0.100 | 0.141 | 0.322 | 0.104 | 0.154 |

As shown in Table 13, Groups 2-13 showed reductions in ALK7 in comparison to Group 1 dosed with no ALK7 RNAi agent, in both iWAT and pgWAT. Particularly, ALK7 RNAi agent AC005824 at 3.0 mg/kg dose achieved ~70% ALK7 inhibition (0.294) in iWAT on Day 15. Dose response was observed in Groups 4&5, 6&7, 8&9, 10&11, and 12&13 in iWAT, and also observed in Groups 2&3, 4&5, 8&9, 10&11, and 12&13 in pgWAT.

Example 3. ALK7-SEAP Mouse Model

To evaluate ALK7 RNAi agents in vivo, an ALK7-SEAP mouse model was used. C57bl6/Albino female mice were transiently transfected in vivo with plasmid by hydrodynamic tail vein (HTV) injection. Mice were injected, via hydrodynamic tail vein (HTV) injection, with plasmid pMIR1066 containing the nucleobases 220-3200 of the ALK7 cDNA sequence (NCBI Reference Sequence: NM_145259.3 (Seq ID No. 1)) inserted into the 3' UTR of the SEAP (secreted human placental alkaline phosphatase) reporter gene. 20 μg of the plasmid containing the ALK7 genome in Ringer's solution in a total volume of 10% of the animal's body weight was injected, via HTV, to create ALK7-SEAP model mice. Following transfection with ALK7-SEAP, the mice were subsequently administered ALK7 RNAi agents. Inhibition of ALK7 gene expression by ALK7 RNAi agent results in concomitant inhibition of SEAP expression. SEAP expression levels were measured by Phospha-Light™ SEAP Reporter Gene Assay System (ThermoFisher Cat #T1016). Prior to treatment, SEAP expression levels in serum were measured and the mice were grouped according to average SEAP levels.

Analyses: SEAP levels may be measured at various times, both before and after administration of ALK7 RNAi agents.

i) Serum collection: Mice were anesthetized with 2-3% isoflurane and blood samples were collected from the submandibular area into serum separation tubes (Sarstedt AG & Co., Nümbrecht, Germany). Blood was allowed to coagulate at ambient temperature for 20 min. The tubes were centrifuged at 8,000×g for 3 min to separate the serum and stored at 4° C.

ii) Serum SEAP levels: Serum was collected and measured by the Phospha-Light™ SEAP Reporter Gene Assay System (ThermoFisher) according to the manufacturer's instructions. Serum SEAP levels for each animal was normalized to the control group of mice injected with saline in order to account for the non-treatment related decline in ALK7 sequence expression with this model. First, the SEAP level for each animal at a time point was divided by the pre-treatment level of expression in that animal ("pre-treatment") in order to determine the ratio of expression "normalized to pre-treatment". Expression at a specific time point was then normalized to the control group by dividing the "normalized to pre-treatment" ratio for an individual animal by the average "normalized to pre-treatment" ratio of all mice in the normal saline control group. Alternatively, in some Examples set forth herein, the serum SEAP levels for each animal were assessed by normalizing to pre-treatment levels only.

Example 4. In Vivo Administration of ALK7 RNAi Agents in ALK7-SEAP Mice

The ALK7-SEAP model described in Example 3, above, was used. On Day −21, four (n=4) female C57bl/6 albino mice in each group were dosed with plasmid containing the nucleobases 220-3200 of the ALK7 cDNA sequence, via HTV injection. On Day 1, the mice were dosed with either isotonic saline or ALK7 RNAi agents formulated in saline (at 3 mg/kg), via subcutaneous (SQ) injection, at 250 μL per 25 g (10 mL/kg) body weight injection volume. The dosing regimen is in accordance with Table 14 below.

TABLE 14

| Dosing for mice of Example 4. | | | |
|---|---|---|---|
| Group | Dose (RNAi Agent) | Dosing Route | # of Animals (n=) |
| 1 | Saline | Day 1 SQ Injection | n = 4 |
| 2 | 3 mg/kg AC004197 | Day 1 SQ Injection | n = 4 |
| 3 | 3 mg/kg AC004198 | Day 1 SQ Injection | n = 4 |
| 4 | 3 mg/kg AC004199 | Day 1 SQ Injection | n = 4 |
| 5 | 3 mg/kg AC004200 | Day 1 SQ Injection | n = 4 |
| 6 | 3 mg/kg AC004201 | Day 1 SQ Injection | n = 4 |
| 7 | 3 mg/kg AC004202 | Day 1 SQ Injection | n = 4 |
| 8 | 3 mg/kg AC004204 | Day 1 SQ Injection | n = 4 |
| 9 | 3 mg/kg AC004205 | Day 1 SQ Injection | n = 4 |
| 10 | 3 mg/kg AC004206 | Day 1 SQ Injection | n = 4 |

TABLE 14-continued

| Dosing for mice of Example 4. | | | |
|---|---|---|---|
| Group | Dose (RNAi Agent) | Dosing Route | # of Animals (n=) |
| 11 | 3 mg/kg AC004207 | Day 1 SQ Injection | n = 4 |
| 12 | 3 mg/kg AC004208 | Day 1 SQ Injection | n = 4 |

Serum was collected on Day −7, 1, 8, 15, and 22. SEAP expression levels were determined pursuant to the procedure set forth in Example 3, above. Data from the experiment are shown in the following Table 15, with average SEAP reflecting the normalized average value of SEAP.

TABLE 15

Average SEAP normalized to pre-treatment and saline control in ALK7-SEAP mice of Example 4.

| | Day 8 | | Day 15 | | Day 22 | |
|---|---|---|---|---|---|---|
| Group ID | Avg SEAP | Std Dev | Avg SEAP | Std Dev | Avg SEAP | Std Dev |
| 1. Saline | 1.000 | 0.091 | 1.000 | 0.299 | 1.000 | 0.231 |
| 2. 3 mg/kg AC004197 | 0.334 | 0.151 | 0.219 | 0.122 | 0.249 | 0.176 |
| 3. 3 mg/kg AC004198 | 0.701 | 0.165 | 0.740 | 0.244 | 0.544 | 0.328 |
| 4. 3 mg/kg AC004199 | 0.452 | 0.105 | 0.473 | 0.213 | 0.457 | 0.143 |
| 5. 3 mg/kg AC004200 | 0.086 | 0.063 | 0.039 | 0.025 | 0.023 | 0.027 |
| 6. 3 mg/kg AC004201 | 0.141 | 0.083 | 0.097 | 0.063 | 0.081 | 0.063 |
| 7. 3 mg/kg AC004202 | 0.164 | 0.018 | 0.076 | 0.053 | 0.053 | 0.042 |
| 8. 3 mg/kg AC004204 | 0.466 | 0.120 | 0.484 | 0.112 | 0.539 | 0.087 |
| 9. 3 mg/kg AC004205 | 0.428 | 0.127 | 0.525 | 0.186 | 0.561 | 0.239 |
| 10. 3 mg/kg AC004206 | 0.267 | 0.126 | 0.170 | 0.073 | 0.208 | 0.067 |
| 11. 3 mg/kg AC004207 | 0.212 | 0.102 | 0.180 | 0.071 | 0.173 | 0.053 |
| 12. 3 mg/kg AC004208 | 0.344 | 0.078 | 0.316 | 0.062 | 0.343 | 0.174 |

Groups 2-12 showed reduction in SEAP-ALK7 at all time points compared to the saline control Group 1. In particular, AC004200 achieved substantial inhibition (0.023, ~98% knockdown) after a single subcutaneous administration of 3 mg/kg at Day 22.

Example 5. In Vivo Administration of ALK7 RNAi Agents in ALK7-SEAP Mice

The ALK7-SEAP model described in Example 3, above, was used. On Day −21, four (n=4) female C57bl/6 albino mice in each group were dosed with plasmid containing the nucleobases 220-3200 of the ALK7 cDNA sequence, via HTV injection. On Day 1, the mice were dosed with either isotonic saline or ALK7 RNAi agents formulated in saline (at 3 mg/kg), via subcutaneous (SQ) injection, at 250 μL per 25 g (10 mL/kg) body weight injection volume. The dosing regimen is in accordance with Table 16 below.

TABLE 16

| Dosing for mice of Example 5. | | | |
|---|---|---|---|
| Group | Dose (RNAi Agent) | Dosing Route | # of Animals (n=) |
| 1 | Saline | Day 1 SQ Injection | n = 4 |
| 2 | 3 mg/kg AC004210 | Day 1 SQ Injection | n = 4 |
| 3 | 3 mg/kg AC004211 | Day 1 SQ Injection | n = 4 |
| 4 | 3 mg/kg AC004212 | Day 1 SQ Injection | n = 4 |
| 5 | 3 mg/kg AC004213 | Day 1 SQ Injection | n = 4 |
| 6 | 3 mg/kg AC004214 | Day 1 SQ Injection | n = 4 |
| 7 | 3 mg/kg AC004215 | Day 1 SQ Injection | n = 4 |
| 8 | 3 mg/kg AC004216 | Day 1 SQ Injection | n = 4 |
| 9 | 3 mg/kg AC004217 | Day 1 SQ Injection | n = 4 |
| 10 | 3 mg/kg AC004218 | Day 1 SQ Injection | n = 4 |
| 11 | 3 mg/kg AC004219 | Day 1 SQ Injection | n = 4 |

TABLE 16-continued

| Dosing for mice of Example 5. | | | |
|---|---|---|---|
| Group | Dose (RNAi Agent) | Dosing Route | # of Animals (n=) |
| 12 | 3 mg/kg AC004220 | Day 1 SQ Injection | n = 4 |
| 13 | 3 mg/kg AC004221 | Day 1 SQ Injection | n = 4 |
| 14 | 3 mg/kg AC004222 | Day 1 SQ Injection | n = 4 |

Serum was collected on Day −6, 1, 8, 15, and 22. SEAP expression levels were determined pursuant to the procedure set forth in Example 3, above. Data from the experiment are shown in the following Table 17, with average SEAP reflecting the normalized average value of SEAP.

TABLE 17

Average SEAP normalized to pre-treatment and saline control in ALK7-SEAP mice of Example 5.

| | Day 8 | | Day 15 | | Day 22 | |
|---|---|---|---|---|---|---|
| Group ID | Avg SEAP | Std Dev | Avg SEAP | Std Dev | Avg SEAP | Std Dev |
| 1. Saline | 1.000 | 0.151 | 1.000 | 0.269 | 1.000 | 0.359 |
| 2. 3 mg/kg AC004210 | 0.388 | 0.154 | 0.225 | 0.203 | 0.221 | 0.197 |
| 3. 3 mg/kg AC004211 | 0.251 | 0.126 | 0.279 | 0.219 | 0.680 | 1.002 |
| 4. 3 mg/kg AC004212 | 0.129 | 0.043 | 0.057 | 0.060 | 0.063 | 0.060 |
| 5. 3 mg/kg AC004213 | 0.375 | 0.119 | 0.223 | 0.150 | 0.140 | 0.122 |
| 6. 3 mg/kg AC004214 | 0.156 | 0.108 | 0.036 | 0.033 | 0.140 | 0.193 |
| 7. 3 mg/kg AC004215 | 0.121 | 0.065 | 0.099 | 0.102 | 0.136 | 0.161 |
| 8. 3 mg/kg AC004216 | 0.235 | 0.127 | 0.082 | 0.084 | 0.177 | 0.163 |
| 9. 3 mg/kg AC004217 | 0.370 | 0.121 | 0.246 | 0.061 | 0.264 | 0.098 |
| 10. 3 mg/kg AC004218 | 0.344 | 0.106 | 0.357 | 0.064 | 0.537 | 0.314 |
| 11. 3 mg/kg AC004219 | 0.487 | 0.136 | 0.290 | 0.079 | 0.316 | 0.117 |
| 12. 3 mg/kg AC004220 | 0.383 | 0.153 | 0.219 | 0.086 | 0.263 | 0.200 |
| 13. 3 mg/kg AC004221 | 0.324 | 0.132 | 0.233 | 0.067 | 0.164 | 0.061 |
| 14. 3 mg/kg AC004222 | 0.139 | 0.062 | 0.091 | 0.032 | 0.044 | 0.016 |

Groups 2-14 showed reduction in SEAP-ALK7 at all time points compared to the saline control Group 1. In particular, on AC004214 achieved substantial inhibition (0.036, ~96% knockdown) after a single subcutaneous administration of 3 mg/kg at Day 15.

Example 6. ALK7-GLuc AAV Mouse Model

To evaluate certain ALK7 RNAi agents, an ALK7-GLuc (Gaussia Luciferase) AAV (Adeno-associated virus) mouse model was used. Six- to eight-week-old male C57BL/6 mice were transduced with ALK7-GLuc AAV serotype 8, administered at least 14 days prior to administration of an ALK7 RNAi agent or control. The genome of the ALK7-GLuc AAV contains the 220-3200 region of the human ALK7 cDNA sequence (GenBank NM_145259.3 (Seq ID No. 1)) inserted into the 3' UTR of the GLuc reporter gene sequence. 5E12 to 1E13 GC/kg (genome copies per kg animal body weight) of the respective virus in PBS in a total volume of 10 mL/kg animal's body weight was injected into mice via the tail vein to create ALK7-GLuc AAV model mice. Inhibition of ALK7 expression by an ALK7 RNAi agent results in concomitant inhibition of GLuc expression, which is measured. Prior to administration of a treatment (between day-7 and day 1 pre-dose), GLuc expression levels in serum were measured by the Pierce™ Gaussia Luciferase Glow Assay Kit (Thermo Fisher Scientific), and the mice were grouped according to average GLuc levels.

Mice were anesthetized with 2-3% isoflurane and blood samples were collected from the submandibular area into serum separation tubes (Sarstedt AG & Co., Nümbrecht, Germany). Blood was allowed to coagulate at ambient temperature for 20 min. The tubes were centrifuged at 8,000×g for 3 min to separate the serum and stored at 4° C. Serum was collected and measured by the Pierce™ Gaussia Luciferase Glow Assay Kit according to the manufacturer's instructions. Serum GLuc levels for each animal can be normalized to the control group of mice injected with vehicle control in order to account for the non-treatment related shift in ALK7 expression with this model. To do so, first, the GLuc level for each animal at a time point was divided by the pre-treatment level of expression in that animal (Day 1) in order to determine the ratio of expression "normalized to pre-treatment". Expression at a specific time point was then normalized to the control group by dividing the "normalized to pre-treatment" ratio for an individual animal by the average "normalized to pre-treatment" ratio of all mice in the normal vehicle control group. Alternatively, the serum GLuc levels for each animal was assessed by normalizing to pre-treatment levels only.

Example 7. In Vivo Administration of ALK7 RNAi Agents in ALK7-Gluc-AAV Mice

The ALK7-GLuc-AAV model as described in Example 6, above, was used. On Day −21, four (n=4) male C57bl/6 mice in each group were dosed with ~5×10^12 GC/kg ALK7-GLuc AAV8, via intravenous IV injection, at 250 μL per 25 g body weight injection volume. On Day 1, the mice were dosed with either saline or ALK7 RNAi agents formulated in saline (at 3.0 mg/kg), via subcutaneous (SQ) injection, at 250 μL per 25 g body weight injection volume. The dosing regimen was in accordance with Table 18 below.

TABLE 18

Dosing Groups of Example 7.

| Group ID | RNAi Agent | Dose | Dosing Regimen | # of Animals (n=) |
|---|---|---|---|---|
| 1 | Saline | N/A | Day 1 SQ Injection | n = 4 |
| 2 | AC004197 | 3.0 mg/kg | Day 1 SQ Injection | n = 4 |
| 3 | AC004198 | 3.0 mg/kg | Day 1 SQ Injection | n = 4 |
| 4 | AC004199 | 3.0 mg/kg | Day 1 SQ Injection | n = 4 |
| 5 | AC004200 | 3.0 mg/kg | Day 1 SQ Injection | n = 4 |
| 6 | AC004201 | 3.0 mg/kg | Day 1 SQ Injection | n = 4 |
| 7 | AC004202 | 3.0 mg/kg | Day 1 SQ Injection | n = 4 |
| 8 | AC004203 | 3.0 mg/kg | Day 1 SQ Injection | n = 4 |
| 9 | AC004204 | 3.0 mg/kg | Day 1 SQ Injection | n = 4 |
| 10 | AC004205 | 3.0 mg/kg | Day 1 SQ Injection | n = 4 |
| 11 | AC004206 | 3.0 mg/kg | Day 1 SQ Injection | n = 4 |
| 12 | AC004207 | 3.0 mg/kg | Day 1 SQ Injection | n = 4 |
| 13 | AC004208 | 3.0 mg/kg | Day 1 SQ Injection | n = 4 |
| 14 | AC004209 | 3.0 mg/kg | Day 1 SQ Injection | n = 4 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 19, with average GLuc reflecting the normalized average value of GLuc. Inhibition of ALK7 expression by an ALK7 RNAi agent results in concomitant inhibition of GLuc expression, which is measured.

TABLE 19

Average GLuc normalized to pre-treatment and saline control in ALK7-Gluc AAV mice of Example 7.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.148 | 1.000 | 0.038 | 1.000 | 0.054 |
| 2. 3.0 mg/kg AC004197 | 0.165 | 0.012 | 0.132 | 0.016 | 0.171 | 0.032 |
| 3. 3.0 mg/kg AC004198 | 0.695 | 0.048 | 0.736 | 0.060 | 0.874 | 0.032 |
| 4. 3.0 mg/kg AC004199 | 0.172 | 0.026 | 0.173 | 0.013 | 0.234 | 0.023 |
| 5. 3.0 mg/kg AC004200 | 0.085 | 0.010 | 0.084 | 0.010 | 0.081 | 0.012 |
| 6. 3.0 mg/kg AC004201 | 0.112 | 0.012 | 0.123 | 0.011 | 0.120 | 0.022 |
| 7. 3.0 mg/kg AC004202 | 0.098 | 0.023 | 0.112 | 0.027 | 0.105 | 0.007 |
| 8. 3.0 mg/kg AC004203 | 0.254 | 0.050 | 0.305 | 0.053 | 0.268 | 0.068 |
| 9. 3.0 mg/kg AC004204 | 0.249 | 0.064 | 0.295 | 0.063 | 0.283 | 0.091 |
| 10. 3.0 mg/kg AC004205 | 0.295 | 0.043 | 0.399 | 0.073 | 0.351 | 0.053 |
| 11. 3.0 mg/kg AC004206 | 0.216 | 0.035 | 0.250 | 0.038 | 0.226 | 0.027 |
| 12. 3.0 mg/kg AC004207 | 0.164 | 0.009 | 0.173 | 0.029 | 0.148 | 0.014 |
| 13. 3.0 mg/kg AC004208 | 0.242 | 0.032 | 0.237 | 0.042 | 0.228 | 0.033 |
| 14. 3.0 mg/kg AC004209 | 0.657 | 0.121 | 0.778 | 0.113 | 0.734 | 0.088 |

Groups 2-14 showed reduction in ALK7-GLuc at all time points compared to the saline control Group 1. Particularly, AC004200 achieved substantial inhibition (0.081, ~92% knockdown) at 3.0 mg/kg on Day 22.

Example 8. In Vivo Administration of ALK7 RNAi Agents in ALK7-Gluc-AAV Mice

The ALK7-GLuc-AAV model as described in Example 6, above, was used. On Day −21, four (n=4) male C57bl/6 mice in each group were dosed with ~5×10^12 GC/kg ALK7-GLuc AAV8, via intravenous IV injection, at 250 μL per 25 g body weight injection volume. On Day 1, the mice were dosed with either saline or ALK7 RNAi agents formulated in saline (at 3.0 mg/kg), via subcutaneous (SQ) injection, at 250 μL per 25 g body weight injection volume. The dosing regimen was in accordance with Table 20 below.

TABLE 20

Dosing Groups of Example 8.

| Group ID | RNAi Agent | Dose | Dosing Regimen | # of Animals (n=) |
|---|---|---|---|---|
| 1 | Saline | N/A | Day 1 SQ Injection | n = 4 |
| 2 | AC004210 | 3.0 mg/kg | Day 1 SQ Injection | n = 4 |
| 3 | AC004211 | 3.0 mg/kg | Day 1 SQ Injection | n = 4 |
| 4 | AC004212 | 3.0 mg/kg | Day 1 SQ Injection | n = 4 |
| 5 | AC004213 | 3.0 mg/kg | Day 1 SQ Injection | n = 4 |
| 6 | AC004214 | 3.0 mg/kg | Day 1 SQ Injection | n = 4 |
| 7 | AC004215 | 3.0 mg/kg | Day 1 SQ Injection | n = 4 |
| 8 | AC004216 | 3.0 mg/kg | Day 1 SQ Injection | n = 4 |
| 9 | AC004217 | 3.0 mg/kg | Day 1 SQ Injection | n = 4 |
| 10 | AC004218 | 3.0 mg/kg | Day 1 SQ Injection | n = 4 |
| 11 | AC004219 | 3.0 mg/kg | Day 1 SQ Injection | n = 4 |
| 12 | AC004220 | 3.0 mg/kg | Day 1 SQ Injection | n = 4 |
| 13 | AC004221 | 3.0 mg/kg | Day 1 SQ Injection | n = 4 |
| 14 | AC004222 | 3.0 mg/kg | Day 1 SQ Injection | n = 4 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 21, with average GLuc reflecting the normalized average value of GLuc. Inhibition of ALK7 expression by an ALK7 RNAi agent results in concomitant inhibition of GLuc expression, which is measured.

TABLE 21

Average GLuc normalized to pre-treatment and saline control in ALK7-Gluc AAV mice of Example 8.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.079 | 1.000 | 0.157 | 1.000 | 0.161 |
| 2. 3.0 mg/kg AC004210 | 0.370 | 0.094 | 0.491 | 0.056 | 0.525 | 0.062 |
| 3. 3.0 mg/kg AC004211 | 0.181 | 0.017 | 0.294 | 0.035 | 0.287 | 0.045 |
| 4. 3.0 mg/kg AC004212 | 0.141 | 0.028 | 0.273 | 0.018 | 0.267 | 0.027 |
| 5. 3.0 mg/kg AC004213 | 0.392 | 0.051 | 0.489 | 0.033 | 0.500 | 0.091 |
| 6. 3.0 mg/kg AC004214 | 0.149 | 0.018 | 0.263 | 0.029 | 0.275 | 0.027 |
| 7. 3.0 mg/kg AC004215 | 0.125 | 0.020 | 0.245 | 0.033 | 0.264 | 0.022 |
| 8. 3.0 mg/kg AC004216 | 0.175 | 0.043 | 0.288 | 0.064 | 0.316 | 0.057 |
| 9. 3.0 mg/kg AC004217 | 0.394 | 0.023 | 0.478 | 0.071 | 0.568 | 0.062 |
| 10. 3.0 mg/kg AC004218 | 0.492 | 0.127 | 0.573 | 0.186 | 0.624 | 0.172 |
| 11. 3.0 mg/kg AC004219 | 0.397 | 0.066 | 0.485 | 0.058 | 0.566 | 0.087 |
| 12. 3.0 mg/kg AC004220 | 0.386 | 0.061 | 0.422 | 0.040 | 0.429 | 0.040 |
| 13. 3.0 mg/kg AC004221 | 0.175 | 0.016 | 0.283 | 0.027 | 0.366 | 0.068 |
| 14. 3.0 mg/kg AC004222 | 0.150 | 0.021 | 0.234 | 0.053 | 0.260 | 0.049 |

Groups 2-14 showed reduction in ALK7-GLuc at all time points compared to the saline control Group 1. In particular, AC004215 achieved ~87% inhibition (0.125) at 3.0 mg/kg on Day 8.

Example 9. In Vivo Administration of ALK7 RNAi Agents in ALK7-Gluc-AAV Mice

The ALK7-GLuc-AAV model as described in Example 6, above, was used. On Day −21, six (n=6) male C57bl/6 mice in each group were dosed with ~5×10^12 GC/kg ALK7-GLuc AAV8, via intravenous IV injection, at 250 µL per 25 g body weight injection volume. On Day 1, the mice were dosed with either saline or ALK7 RNAi agents formulated in saline (at 0.75 or 1.5 mg/kg), via subcutaneous (SQ) injection, at 250 µL per 25 g body weight injection volume. The dosing regimen was in accordance with Table 22 below.

TABLE 22

Dosing Groups of Example 9.

| Group ID | RNAi Agent | Dose | Dosing Regimen | # of Animals (n=) |
|---|---|---|---|---|
| 1 | Saline | N/A | Day 1 SQ Injection | n = 6 |
| 2 | AC004200 | 0.75 mg/kg | Day 1 SQ Injection | n = 6 |
| 3 | AC004200 | 1.5 mg/kg | Day 1 SQ Injection | n = 6 |
| 4 | AC004201 | 0.75 mg/kg | Day 1 SQ Injection | n = 6 |
| 5 | AC004201 | 1.5 mg/kg | Day 1 SQ Injection | n = 6 |
| 6 | AC004202 | 0.75 mg/kg | Day 1 SQ Injection | n = 6 |
| 7 | AC004202 | 1.5 mg/kg | Day 1 SQ Injection | n = 6 |
| 8 | AC004212 | 0.75 mg/kg | Day 1 SQ Injection | n = 6 |
| 9 | AC004212 | 1.5 mg/kg | Day 1 SQ Injection | n = 6 |
| 10 | AC004214 | 0.75 mg/kg | Day 1 SQ Injection | n = 6 |
| 11 | AC004214 | 1.5 mg/kg | Day 1 SQ Injection | n = 6 |
| 12 | AC004215 | 0.75 mg/kg | Day 1 SQ Injection | n = 6 |
| 13 | AC004215 | 1.5 mg/kg | Day 1 SQ Injection | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 23, with average GLuc reflecting the normalized average value of GLuc. Inhibition of ALK7 expression by an ALK7 RNAi agent results in concomitant inhibition of GLuc expression, which is measured.

TABLE 23

Average GLuc normalized to pre-treatment and saline control in ALK7-Gluc AAV mice of Example 9.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.168 | 1.000 | 0.174 | 1.000 | 0.111 |
| 2. 0.75 mg/kg AC004200 | 0.198 | 0.054 | 0.187 | 0.034 | 0.194 | 0.047 |
| 3. 1.5 mg/kg AC004200 | 0.098 | 0.016 | 0.097 | 0.023 | 0.100 | 0.032 |
| 4. 0.75 mg/kg AC004201 | 0.342 | 0.072 | 0.339 | 0.055 | 0.386 | 0.139 |
| 5. 1.5 mg/kg AC004201 | 0.156 | 0.048 | 0.191 | 0.037 | 0.178 | 0.032 |
| 6. 0.75 mg/kg AC004202 | 0.218 | 0.048 | 0.242 | 0.046 | 0.285 | 0.051 |
| 7. 1.5 mg/kg AC004202 | 0.138 | 0.016 | 0.128 | 0.024 | 0.170 | 0.033 |
| 8. 0.75 mg/kg AC004212 | 0.300 | 0.047 | 0.279 | 0.032 | 0.319 | 0.061 |
| 9. 1.5 mg/kg AC004212 | 0.149 | 0.034 | 0.140 | 0.024 | 0.154 | 0.026 |
| 10. 0.75 mg/kg AC004214 | 0.253 | 0.032 | 0.220 | 0.013 | 0.208 | 0.021 |
| 11. 1.5 mg/kg AC004214 | 0.145 | 0.022 | 0.165 | 0.018 | 0.155 | 0.015 |
| 12. 0.75 mg/kg AC004215 | 0.303 | 0.056 | 0.355 | 0.064 | 0.365 | 0.088 |
| 13. 1.5 mg/kg AC004215 | 0.212 | 0.013 | 0.211 | 0.039 | 0.197 | 0.031 |

Groups 2-13 showed reduction in ALK7-GLuc at all time points compared to the saline control Group 1. Particularly, AC004200 achieved ~90% inhibition (0.097) at 1.5 mg/kg on Day 15. Furthermore, dose response was observed for each of the ALK7 RNAi agent tested, at all time points.

Example 10. In Vivo Administration of ALK7 RNAi Agents in ALK7-Gluc-AAV Mice

The ALK7-GLuc-AAV model as described in Example 6, above, was used. On Day −21, six (n=6) male C57bl/6 mice in each group were dosed with ~5×10^12 GC/kg ALK7-GLuc AAV8, via intravenous IV injection, at 250 µL per 25 g body weight injection volume. On Day 1, the mice were dosed with either saline or ALK7 RNAi agents formulated in saline (at 1.5 mg/kg), via subcutaneous (SQ) injection, at 250 µL per 25 g body weight injection volume. The dosing regimen was in accordance with Table 24 below.

TABLE 24

Dosing Groups of Example 10.

| Group ID | RNAi Agent | Dose | Dosing Regimen | # of Animals (n=) |
|---|---|---|---|---|
| 1 | Saline | N/A | Day 1 SQ Injection | n = 6 |
| 2 | AC004200 | 1.5 mg/kg | Day 1 SQ Injection | n = 6 |
| 3 | AC005846 | 1.5 mg/kg | Day 1 SQ Injection | n = 6 |
| 4 | AC005847 | 1.5 mg/kg | Day 1 SQ Injection | n = 6 |
| 5 | AC005848 | 1.5 mg/kg | Day 1 SQ Injection | n = 6 |
| 6 | AC005849 | 1.5 mg/kg | Day 1 SQ Injection | n = 6 |
| 7 | AC005850 | 1.5 mg/kg | Day 1 SQ Injection | n = 6 |
| 8 | AC005851 | 1.5 mg/kg | Day 1 SQ Injection | n = 6 |
| 9 | AC005852 | 1.5 mg/kg | Day 1 SQ Injection | n = 6 |
| 10 | AC005853 | 1.5 mg/kg | Day 1 SQ Injection | n = 6 |
| 11 | AC005855 | 1.5 mg/kg | Day 1 SQ Injection | n = 6 |
| 12 | AC005854 | 1.5 mg/kg | Day 1 SQ Injection | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 25, with average GLuc reflecting the normalized average value of GLuc. Inhibition of ALK7 expression by an ALK7 RNAi agent results in concomitant inhibition of GLuc expression, which is measured.

TABLE 25

Average GLuc normalized to pre-treatment and saline control in ALK7-Gluc AAV mice of Example 10.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.115 | 1.000 | 0.163 | 1.000 | 0.170 |
| 2. 1.5 mg/kg AC004200 | 0.192 | 0.046 | 0.132 | 0.034 | 0.131 | 0.017 |
| 3. 1.5 mg/kg AC005846 | 0.177 | 0.043 | 0.107 | 0.012 | 0.111 | 0.014 |
| 4. 1.5 mg/kg AC005847 | 0.187 | 0.025 | 0.105 | 0.017 | 0.113 | 0.015 |
| 5. 1.5 mg/kg AC005848 | 0.225 | 0.064 | 0.121 | 0.019 | 0.145 | 0.019 |
| 6. 1.5 mg/kg AC005849 | 0.286 | 0.071 | 0.140 | 0.038 | 0.204 | 0.047 |
| 7. 1.5 mg/kg AC005850 | 0.267 | 0.058 | 0.138 | 0.027 | 0.163 | 0.033 |
| 8. 1.5 mg/kg AC005851 | 0.238 | 0.065 | 0.123 | 0.020 | 0.131 | 0.020 |
| 9. 1.5 mg/kg AC005852 | 0.326 | 0.043 | 0.175 | 0.019 | 0.231 | 0.049 |
| 10. 1.5 mg/kg AC005853 | 0.251 | 0.091 | 0.150 | 0.051 | 0.179 | 0.049 |
| 11. 1.5 mg/kg AC005855 | 0.239 | 0.050 | 0.141 | 0.035 | 0.189 | 0.052 |
| 12. 1.5 mg/kg AC005854 | 0.156 | 0.035 | 0.098 | 0.030 | 0.139 | 0.028 |

Groups 2-12 showed reduction in ALK7-GLuc at all time points compared to the saline control Group 1. Particularly, AC005854 achieved ~90% inhibition (0.098) at 1.5 mg/kg on Day 15.

Example 11. In Vivo Administration of ALK7 RNAi Agents in ALK7-Gluc-AAV Mice

The ALK7-GLuc-AAV model as described in Example 6, above, was used. On Day −21, six (n=6) male C57bl/6 mice in each group were dosed with ~5×10^12 GC/kg ALK7-GLuc AAV8, via intravenous IV injection, at 250 µL per 25 g body weight injection volume. On Day 1, the mice were dosed with either saline or ALK7 RNAi agents formulated in saline (at 1.5 mg/kg), via subcutaneous (SQ) injection, at 250 µL per 25 g body weight injection volume. The dosing regimen was in accordance with Table 26 below.

TABLE 26

Dosing Groups of Example 11.

| Group ID | RNAi Agent | Dose | Dosing Regimen | # of Animals (n=) |
|---|---|---|---|---|
| 1 | Saline | N/A | Day 1 SQ Injection | n = 6 |
| 2 | AC004202 | 1.5 mg/kg | Day 1 SQ Injection | n = 6 |
| 3 | AC005867 | 1.5 mg/kg | Day 1 SQ Injection | n = 6 |
| 4 | AC005868 | 1.5 mg/kg | Day 1 SQ Injection | n = 6 |
| 5 | AC005869 | 1.5 mg/kg | Day 1 SQ Injection | n = 6 |
| 6 | AC005870 | 1.5 mg/kg | Day 1 SQ Injection | n = 6 |
| 7 | AC005871 | 1.5 mg/kg | Day 1 SQ Injection | n = 6 |
| 8 | AC005872 | 1.5 mg/kg | Day 1 SQ Injection | n = 6 |
| 9 | AC005873 | 1.5 mg/kg | Day 1 SQ Injection | n = 6 |
| 10 | AC005874 | 1.5 mg/kg | Day 1 SQ Injection | n = 6 |
| 11 | AC005875 | 1.5 mg/kg | Day 1 SQ Injection | n = 6 |
| 12 | AC005876 | 1.5 mg/kg | Day 1 SQ Injection | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 27, with average GLuc reflecting the normalized average value of GLuc. Inhibition of ALK7 expression by an ALK7 RNAi agent results in concomitant inhibition of GLuc expression, which is measured.

TABLE 27

Average GLuc normalized to pre-treatment and saline control in ALK7-Gluc AAV mice of Example 11.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.074 | 1.000 | 0.186 | 1.000 | 0.189 |
| 2. 1.5 mg/kg AC004202 | 0.154 | 0.020 | 0.187 | 0.026 | 0.230 | 0.038 |
| 3. 1.5 mg/kg AC005867 | 0.253 | 0.068 | 0.304 | 0.057 | 0.335 | 0.078 |
| 4. 1.5 mg/kg AC005868 | 0.170 | 0.030 | 0.228 | 0.032 | 0.271 | 0.054 |
| 5. 1.5 mg/kg AC005869 | 0.214 | 0.046 | 0.276 | 0.082 | 0.305 | 0.076 |
| 6. 1.5 mg/kg AC005870 | 0.307 | 0.064 | 0.353 | 0.080 | 0.385 | 0.067 |
| 7. 1.5 mg/kg AC005871 | 0.368 | 0.352 | 0.466 | 0.509 | 0.458 | 0.400 |
| 8. 1.5 mg/kg AC005872 | 0.250 | 0.037 | 0.323 | 0.037 | 0.434 | 0.137 |
| 9. 1.5 mg/kg AC005873 | 0.217 | 0.020 | 0.268 | 0.058 | 0.310 | 0.037 |
| 10. 1.5 mg/kg AC005874 | 0.244 | 0.021 | 0.288 | 0.030 | 0.321 | 0.055 |
| 11. 1.5 mg/kg AC005875 | 0.217 | 0.043 | 0.252 | 0.057 | 0.340 | 0.073 |
| 12. 1.5 mg/kg AC005876 | 0.254 | 0.073 | 0.297 | 0.086 | 0.316 | 0.088 |

Groups 2-12 showed reduction in ALK7-GLuc at all time points compared to the saline control Group 1. Particularly, AC004202 achieved ~85% inhibition (0.154) at 1.5 mg/kg on Day 8.

Example 12. In Vivo Administration of ALK7 RNAi Agents in ALK7-Gluc-AAV Mice

The ALK7-GLuc-AAV model as described in Example 6, above, was used. On Day −21, five (n=5) male C57bl/6 mice in each group were dosed with ~5×10^12 GC/kg ALK7-GLuc AAV8, via intravenous IV injection, at 250 µL per 25 g body weight injection volume. On Day 1, the mice were dosed with either saline or ALK7 RNAi agents formulated in saline (at 1.5 mg/kg), via subcutaneous (SQ) injection, at 250 µL per 25 g body weight injection volume. The dosing regimen was in accordance with Table 28 below.

TABLE 28

Dosing Groups of Example 12.

| Group ID | RNAi Agent | Dose | Dosing Regimen | # of Animals (n=) |
|---|---|---|---|---|
| 1 | Saline | N/A | Day 1 SQ Injection | n = 5 |
| 2 | AC004201 | 1.5 mg/kg | Day 1 SQ Injection | n = 5 |
| 3 | AC005856 | 1.5 mg/kg | Day 1 SQ Injection | n = 5 |
| 4 | AC005857 | 1.5 mg/kg | Day 1 SQ Injection | n = 5 |
| 5 | AC006111 | 1.5 mg/kg | Day 1 SQ Injection | n = 5 |
| 6 | AC005858 | 1.5 mg/kg | Day 1 SQ Injection | n = 5 |
| 7 | AC005859 | 1.5 mg/kg | Day 1 SQ Injection | n = 5 |
| 8 | AC005860 | 1.5 mg/kg | Day 1 SQ Injection | n = 5 |
| 9 | AC005861 | 1.5 mg/kg | Day 1 SQ Injection | n = 5 |
| 10 | AC005862 | 1.5 mg/kg | Day 1 SQ Injection | n = 5 |
| 11 | AC005863 | 1.5 mg/kg | Day 1 SQ Injection | n = 5 |
| 12 | AC005864 | 1.5 mg/kg | Day 1 SQ Injection | n = 5 |
| 13 | AC005865 | 1.5 mg/kg | Day 1 SQ Injection | n = 5 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 29, with average GLuc reflecting the normalized average value of GLuc. Inhibition of ALK7 expression by an ALK7 RNAi agent results in concomitant inhibition of GLuc expression, which is measured.

TABLE 29

Average GLuc normalized to pre-treatment and saline control in ALK7-Gluc AAV mice of Example 12.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. 1.5 mg/kg Saline | 1.000 | 0.324 | 1.000 | 0.181 | 1.000 | 0.322 |
| 2. 1.5 mg/kg AC004201 | 0.228 | 0.039 | 0.204 | 0.040 | 0.228 | 0.057 |
| 3. 1.5 mg/kg AC005856 | 0.311 | 0.082 | 0.292 | 0.086 | 0.307 | 0.066 |
| 4. 1.5 mg/kg AC005857 | 0.193 | 0.047 | 0.143 | 0.038 | 0.183 | 0.037 |
| 5. 1.5 mg/kg AC006111 | 0.172 | 0.036 | 0.172 | 0.026 | 0.206 | 0.051 |
| 6. 1.5 mg/kg AC005858 | 0.177 | 0.078 | 0.143 | 0.055 | 0.197 | 0.095 |
| 7. 1.5 mg/kg AC005859 | 0.322 | 0.087 | 0.256 | 0.097 | 0.321 | 0.115 |
| 8. 1.5 mg/kg AC005860 | 0.589 | 0.158 | 0.514 | 0.064 | 0.579 | 0.073 |
| 9. 1.5 mg/kg AC005861 | 0.275 | 0.087 | 0.217 | 0.048 | 0.257 | 0.078 |
| 10. 1.5 mg/kg AC005862 | 0.480 | 0.196 | 0.412 | 0.186 | 0.581 | 0.206 |
| 11. 1.5 mg/kg AC005863 | 0.390 | 0.080 | 0.339 | 0.062 | 0.469 | 0.101 |
| 12. 1.5 mg/kg AC005864 | 0.127 | 0.051 | 0.147 | 0.091 | 0.187 | 0.108 |
| 13. 1.5 mg/kg AC005865 | 0.541 | 0.063 | 0.437 | 0.114 | 0.598 | 0.120 |

Groups 2-13 showed reduction in ALK7-GLuc at all time points compared to the saline control Group 1. Particularly, AC005864 achieved ~87% inhibition (0.127) at 1.5 mg/kg on Day 8.

Example 13. In Vivo Administration of ALK7 RNAi Agents in Cynomolgus Monkeys

ALK7 RNAi agents were tested in Cynomolgus monkeys for inhibition of ALK7. On Day 1 and Day 29, three (n=3) male Cynomolgus monkeys for each test group were dosed with ALK7 RNAi agents formulated in saline (at 3.0 mg/kg), via subcutaneous (SQ) injection with syringe and needle in the mid-scapular region, at 0.3 mL/kg dose volume. Adipose biopsies were collected from all test animals on Day −7 (pre-dose), 15, 29, 57, and 85. The dosing regimen was in accordance with Table 30 below.

TABLE 30

Dosing for test animals of Example 13.

| Group | Dose (RNAi Agent) | # of Animals | Dosing Route | Dose Volume |
|---|---|---|---|---|
| 1 | 3.0 mg/kg AC006188 | n = 3 | Day 1 & 29 SQ Injection | 0.3 mL/kg |
| 2 | 3.0 mg/kg AC006189 | n = 3 | Day 1 & 29 SQ Injection | 0.3 mL/kg |

All animals were fasted for at least 12 hours and less than 24 hours for scheduled blood collections and biopsy procedures. Blood collection site was femoral vein. A saphenous vein (not used for dose administration) may be used as an alternative collection site.

Adipose biopsies were collected as a sedated procedure. Sedation was accomplished using Ketamine HCl (10 mg/kg) or Telazol (5-8 mg/kg), administered as an intramuscular (IM) injection and supplemented with Ketamine (5 mg/kg) as needed.

An approximate 3-5 cm skin incision was made followed by collection of adipose tissue (optimally 50-150 mg). The skin will then be closed in a routine manner using suture (or alternate) materials maintaining aseptic technique.

Each biopsy site was separated by at least 1-2 cm. Biopsies were separated into 2 pieces (one piece of ~25 to 75 mg and second piece of ~25-75 mg) for each collection time point. Analgesics may be administered at veterinarian's discretion.

Blood was collected into tubes containing no anticoagulant (serum separator tubes). Blood was allowed to clot at ambient temperature prior to centrifugation to obtain serum.

Blood was collected on Day −7, Day 1, Day 15, Day 29, Day 57, and Day 85, prior to biopsy sample collections or dose administration (when applicable), and from any animals found in moribund condition or sacrificed at an unscheduled interval. Samples may be further collected at additional timepoints. Should there be any additional collected samples at other timepoints, their corresponding relevant data are shown below.

Individual doses of ALK7 RNAi agents were calculated based on the body weights recorded on each day of dosing.

The adipose biopsies and serum collected from the test animals were used for analysis for ALK7 expression and additional biological parameters. ALK7 mRNA expression levels were quantified via qPCR, using cARL1 as the endogenous control gene, normalized to Day −7. The data is shown in the following Table 31.

Each of the ALK7 RNAi agents included modified nucleotides that were conjugated at the 5' terminal end and the 3' terminal end of the sense strand to a lipid moiety having the modified sequences as set forth in the duplex structures herein (see Tables 3, 6, 6a, 8, 9, and 10, for specific modifications and structure information related to the ALK7 RNAi agents; see Table 11 for structures of LP-379-a and LP-371-a).

TABLE 31

ALK7 expression in adipose tissues of Cynomolgus monkeys of Example 13.

| Group ID | Day −7 Rel. Exp. | Day −7 Error Low | Day −7 Error High | Day 15 Rel. Exp. | Day 15 Error Low | Day 15 Error High |
|---|---|---|---|---|---|---|
| 1. 3.0 mg/kg AC006188 | 1.000 | 0.212 | 0.269 | 0.171 | 0.073 | 0.128 |
| 2. 3.0 mg/kg AC006189 | 1.000 | 0.161 | 0.191 | 0.105 | 0.054 | 0.110 |

| Group ID | Day 29 Rel. Exp. | Day 29 Error Low | Day 29 Error High | Day 57 Rel. Exp. | Day 57 Error Low | Day 57 Error High |
|---|---|---|---|---|---|---|
| 1. 3.0 mg/kg AC006188 | 0.119 | 0.051 | 0.090 | 0.205 | 0.028 | 0.032 |
| 2. 3.0 mg/kg AC006189 | 0.139 | 0.032 | 0.041 | 0.212 | 0.044 | 0.056 |

TABLE 31-continued

ALK7 expression in adipose tissues of Cynomolgus monkeys of Example 13.

| Group ID | Day 85 Rel. Exp. | Day 85 Error Low | Day 85 Error High | Day 113 Rel. Exp. | Day 113 Error Low | Day 113 Error High |
|---|---|---|---|---|---|---|
| 1. 3.0 mg/kg AC006188 | 0.229 | 0.075 | 0.111 | 0.197 | 0.055 | 0.075 |
| 2. 3.0 mg/kg AC006189 | 0.285 | 0.125 | 0.221 | 0.321 | 0.172 | 0.372 |

Both Groups 1 and 2, AC006188 and AC006189 showed significant inhibition of ALK7 in cynomolgus monkeys' adipose tissues. Most notably, at nadir, AC006189 achieved ~89% ALK7 inhibition (0.105) at 3.0 mg/kg on Day 15. Both AC006188 and AC006189 showed ALK7 inhibition out to at least Day 113, with AC006188 achieving ~80% ALK7 inhibition (0.197) at 3.0 mg/kg (2× dose on Day 1 and Day 29) on Day 113.

Example 14. In Vivo Administration of ALK7 RNAi Agents in ALK7-Gluc-AAV Mice

The ALK7-GLuc-AAV model as described in Example 6, above, was used. On Day −21, five (n=5) male C57bl/6 mice in each group were dosed with ~5×10^12 GC/kg ALK7-GLuc AAV8, via intravenous IV injection, at 250 μL per 25 g body weight injection volume. On Day 1, the mice were dosed with either saline or ALK7 RNAi agents formulated in saline (at 1.5 mg/kg), via subcutaneous (SQ) injection, at 250 μL per 25 g body weight injection volume. The dosing regimen was in accordance with Table 32 below.

TABLE 32

Dosing Groups of Example 14.

| Group ID | RNAi Agent | Dose | Dosing Regimen | # of Animals (n=) |
|---|---|---|---|---|
| 1 | Saline | N/A | Day 1 SQ Injection | n = 5 |
| 2 | AC006111 | 1.5 mg/kg | Day 1 SQ Injection | n = 5 |
| 3 | AC006738 | 1.5 mg/kg | Day 1 SQ Injection | n = 5 |
| 4 | AC006747 | 1.5 mg/kg | Day 1 SQ Injection | n = 5 |
| 5 | AC006773 | 1.5 mg/kg | Day 1 SQ Injection | n = 5 |
| 6 | AC004202 | 1.5 mg/kg | Day 1 SQ Injection | n = 5 |
| 7 | AC006741 | 1.5 mg/kg | Day 1 SQ Injection | n = 5 |
| 8 | AC006742 | 1.5 mg/kg | Day 1 SQ Injection | n = 5 |
| 9 | AC006743 | 1.5 mg/kg | Day 1 SQ Injection | n = 5 |
| 10 | AC004212 | 1.5 mg/kg | Day 1 SQ Injection | n = 5 |
| 11 | AC006744 | 1.5 mg/kg | Day 1 SQ Injection | n = 5 |
| 12 | AC006745 | 1.5 mg/kg | Day 1 SQ Injection | n = 5 |
| 13 | AC006746 | 1.5 mg/kg | Day 1 SQ Injection | n = 5 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 33, with average GLuc reflecting the normalized average value of GLuc. Inhibition of ALK7 expression by an ALK7 RNAi agent results in concomitant inhibition of GLuc expression, which is measured.

TABLE 33

Average GLuc normalized to pre-treatment and saline control in ALK7-Gluc AAV mice of Example 14.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.149 | 1.000 | 0.160 | 1.000 | 0.100 |
| 2. 1.5 mg/kg AC006111 | 0.200 | 0.059 | 0.151 | 0.040 | 0.388 | 0.056 |
| 3. 1.5 mg/kg AC006738 | 0.582 | 0.168 | 0.401 | 0.066 | 0.692 | 0.146 |
| 4. 1.5 mg/kg AC006747 | 0.346 | 0.058 | 0.345 | 0.090 | 0.545 | 0.086 |
| 5. 1.5 mg/kg AC006773 | 0.342 | 0.059 | 0.271 | 0.053 | 0.568 | 0.091 |
| 6. 1.5 mg/kg AC004202 | 0.184 | 0.046 | 0.160 | 0.045 | 0.385 | 0.088 |
| 7. 1.5 mg/kg AC006741 | 0.300 | 0.056 | 0.172 | 0.017 | 0.415 | 0.078 |
| 8. 1.5 mg/kg AC006742 | 0.283 | 0.090 | 0.171 | 0.037 | 0.447 | 0.081 |
| 9. 1.5 mg/kg AC006743 | 0.236 | 0.068 | 0.241 | 0.107 | 0.347 | 0.162 |
| 10. 1.5 mg/kg AC004212 | 0.271 | 0.064 | 0.237 | 0.018 | 0.445 | 0.085 |
| 11. 1.5 mg/kg AC006744 | 0.239 | 0.049 | 0.182 | 0.020 | 0.343 | 0.032 |
| 12. 1.5 mg/kg AC006745 | 0.223 | 0.023 | 0.165 | 0.039 | 0.315 | 0.068 |
| 13. 1.5 mg/kg AC006746 | 0.198 | 0.036 | 0.140 | 0.028 | 0.314 | 0.084 |

Groups 2-13 showed reduction in ALK7-GLuc at all time points compared to the saline control Group 1. Particularly, AC006746 achieved ~86% inhibition (0.140) at 1.5 mg/kg on Day 15.

Example 15. In Vivo Administration of ALK7 RNAi Agents in ALK7-Gluc-AAV Mice

The ALK7-GLuc-AAV model as described in Example 6, above, was used. On Day −21, six (n=6) male C57bl/6 mice in each group were dosed with ~4×10^12 GC/kg ALK7-GLuc AAV8, via intravenous IV injection, at 250 μL per 25 g body weight injection volume. On Day 1, the mice were dosed with either saline or ALK7 RNAi agents formulated in saline (at 1.5 mg/kg), via subcutaneous (SQ) injection, at 250 μL per 25 g body weight injection volume. The dosing regimen was in accordance with Table 34 below.

TABLE 34

Dosing Groups of Example 15.

| Group ID | RNAi Agent | Dose | Dosing Regimen | # of Animals (n=) |
|---|---|---|---|---|
| 1 | Saline | N/A | Day 1 SQ Injection | n = 6 |
| 2 | AC005847 | 1.5 mg/kg | Day 1 SQ Injection | n = 6 |
| 3 | AC007192 | 1.5 mg/kg | Day 1 SQ Injection | n = 6 |
| 4 | AC007193 | 1.5 mg/kg | Day 1 SQ Injection | n = 6 |
| 5 | AC007194 | 1.5 mg/kg | Day 1 SQ Injection | n = 6 |
| 6 | AC007195 | 1.5 mg/kg | Day 1 SQ Injection | n = 6 |
| 7 | AC007196 | 1.5 mg/kg | Day 1 SQ Injection | n = 6 |
| 8 | AC007197 | 1.5 mg/kg | Day 1 SQ Injection | n = 6 |
| 9 | AC007198 | 1.5 mg/kg | Day 1 SQ Injection | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 35, with average GLuc reflecting the normalized average value of GLuc. Inhibition of ALK7 expression by an ALK7 RNAi agent results in concomitant inhibition of GLuc expression, which is measured.

TABLE 35

Average GLuc normalized to pre-treatment and saline control in ALK7-Gluc AAV mice of Example 15.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.055 | 1.000 | 0.085 | 1.000 | 0.103 |
| 2. 1.5 mg/kg AC005847 | 0.197 | 0.068 | 0.112 | 0.058 | 0.089 | 0.035 |
| 3. 1.5 mg/kg AC007192 | 0.193 | 0.040 | 0.182 | 0.028 | 0.172 | 0.044 |
| 4. 1.5 mg/kg AC007193 | 0.183 | 0.033 | 0.156 | 0.030 | 0.124 | 0.022 |
| 5. 1.5 mg/kg AC007194 | 0.217 | 0.030 | 0.193 | 0.048 | 0.171 | 0.028 |
| 6. 1.5 mg/kg AC007195 | 0.327 | 0.052 | 0.245 | 0.034 | 0.225 | 0.062 |
| 7. 1.5 mg/kg AC007196 | 0.149 | 0.014 | 0.146 | 0.044 | 0.159 | 0.030 |
| 8. 1.5 mg/kg AC007197 | 0.799 | 0.273 | 1.104 | 0.239 | 0.840 | 0.246 |
| 9. 1.5 mg/kg AC007198 | 1.053 | 0.183 | 1.238 | 0.377 | 0.960 | 0.347 |

Groups 2-7 showed reduction in ALK7-GLuc at all time points compared to the saline control Group 1. Groups 8 and 9 showed little to negligible reduction in ALK7-Gluc at all time points compared to the saline control Group 1. Particularly, AC005847 achieved ~91% inhibition (0.089) at 1.5 mg/kg on Day 22.

Example 16. In Vivo Administration of ALK7 RNAi Agents in ALK7-SEAP Mice

The ALK7-SEAP model described in Example 3, above, was used. On Day −21, six (n=6) female C57bl/6 albino mice in each group were dosed with plasmid containing the nucleobases 220-3200 of the ALK7 cDNA sequence, via HTV injection. On Day 1, the mice were dosed with either isotonic saline or ALK7 RNAi agents formulated in saline (at 1.5 mg/kg), via subcutaneous (SQ) injection, at 250 μL per 25 g (10 mL/kg) body weight injection volume. The dosing regimen is in accordance with Table 36 below.

TABLE 36

Dosing for mice of Example 16.

| Group | Dose (RNAi Agent) | Dosing Route | # of Animals (n=) |
|---|---|---|---|
| 1 | Saline | Day 1 SQ Injection | n = 6 |
| 2 | 1.5 mg/kg AC004212 | Day 1 SQ Injection | n = 6 |
| 3 | 1.5 mg/kg AC006290 | Day 1 SQ Injection | n = 6 |
| 4 | 1.5 mg/kg AC006291 | Day 1 SQ Injection | n = 6 |
| 5 | 1.5 mg/kg AC006292 | Day 1 SQ Injection | n = 6 |
| 6 | 1.5 mg/kg AC006293 | Day 1 SQ Injection | n = 6 |
| 7 | 1.5 mg/kg AC006294 | Day 1 SQ Injection | n = 6 |
| 8 | 1.5 mg/kg AC006295 | Day 1 SQ Injection | n = 6 |

TABLE 36-continued

Dosing for mice of Example 16.

| Group | Dose (RNAi Agent) | Dosing Route | # of Animals (n=) |
|---|---|---|---|
| 9 | 1.5 mg/kg AC006296 | Day 1 SQ Injection | n = 6 |
| 10 | 1.5 mg/kg AC006297 | Day 1 SQ Injection | n = 6 |
| 11 | 1.5 mg/kg AC006298 | Day 1 SQ Injection | n = 6 |
| 12 | 1.5 mg/kg AC006299 | Day 1 SQ Injection | n = 6 |
| 13 | 1.5 mg/kg AC006300 | Day 1 SQ Injection | n = 6 |

Serum was collected on Day −6, 1, 8, 15, and 22. SEAP expression levels were determined pursuant to the procedure set forth in Example 3, above. Data from the experiment are shown in the following Table 37, with average SEAP reflecting the normalized average value of SEAP.

TABLE 37

Average SEAP normalized to pre-treatment and saline control in ALK7-SEAP mice of Example 16.

| Group ID | Day 8 | | Day 15 | | Day 22 | |
|---|---|---|---|---|---|---|
| | Avg SEAP | Std Dev | Avg SEAP | Std Dev | Avg SEAP | Std Dev |
| 1. Saline | 1.000 | 0.120 | 1.000 | 0.149 | 1.000 | 0.226 |
| 2. 1.5 mg/kg AC004212 | 0.267 | 0.053 | 0.201 | 0.050 | 0.257 | 0.066 |
| 3. 1.5 mg/kg AC006290 | 0.316 | 0.081 | 0.260 | 0.133 | 0.371 | 0.178 |
| 4. 1.5 mg/kg AC006291 | 0.391 | 0.034 | 0.281 | 0.036 | 0.368 | 0.040 |
| 5. 1.5 mg/kg AC006292 | 0.425 | 0.060 | 0.347 | 0.072 | 0.378 | 0.083 |
| 6. 1.5 mg/kg AC006293 | 0.535 | 0.100 | 0.378 | 0.096 | 0.475 | 0.146 |
| 7. 1.5 mg/kg AC006294 | 0.328 | 0.029 | 0.240 | 0.050 | 0.313 | 0.055 |
| 8. 1.5 mg/kg AC006295 | 0.669 | 0.096 | 0.699 | 0.107 | 0.895 | 0.180 |
| 9. 1.5 mg/kg AC006296 | 0.545 | 0.074 | 0.615 | 0.111 | 0.787 | 0.211 |
| 10. 1.5 mg/kg AC006297 | 0.443 | 0.084 | 0.456 | 0.126 | 0.581 | 0.171 |
| 11. 1.5 mg/kg AC006298 | 0.424 | 0.065 | 0.413 | 0.103 | 0.589 | 0.144 |
| 12. 1.5 mg/kg AC006299 | 0.298 | 0.035 | 0.253 | 0.053 | 0.339 | 0.099 |
| 13. 1.5 mg/kg AC006300 | 0.268 | 0.051 | 0.188 | 0.057 | 0.251 | 0.068 |

Groups 2-13 showed reduction in SEAP-ALK7 at all time points compared to the saline control Group 1. In particular, on AC006300 achieved substantial inhibition (0.188, ~81% knockdown) after a single subcutaneous administration of 1.5 mg/kg at Day 15.

Example 17. In Vivo Administration of ALK7 RNAi Agents in Mice

ALK7 RNAi agents were tested in vivo in mice. On Day 1, five (n=5) female C57bl/6 mice in each group were dosed with either isotonic saline or ALK7 RNAi agents formulated in saline (at 1.5 mg/kg), via subcutaneous (SQ) injection, at 250 μL per 25 g body weight injection volume. The dosing regimen is in accordance with Table 38 below.

TABLE 38

Dosing for mice of Example 17.

| Group | Dose (RNAi Agent) | Dosing Route | # of Animals (n=) |
|---|---|---|---|
| 1 | Saline | Day 1 SQ Injection | n = 5 |
| 2 | 1.5 mg/kg AC005824 | Day 1 SQ Injection | n = 5 |
| 3 | 1.5 mg/kg AC006643 | Day 1 SQ Injection | n = 5 |
| 4 | 1.5 mg/kg AC006644 | Day 1 SQ Injection | n = 5 |
| 5 | 1.5 mg/kg AC006645 | Day 1 SQ Injection | n = 5 |
| 6 | 1.5 mg/kg AC006646 | Day 1 SQ Injection | n = 5 |
| 7 | 1.5 mg/kg AC006647 | Day 1 SQ Injection | n = 5 |
| 8 | 1.5 mg/kg AC006648 | Day 1 SQ Injection | n = 5 |

TABLE 38-continued

Dosing for mice of Example 17.

| Group | Dose (RNAi Agent) | Dosing Route | # of Animals (n=) |
|---|---|---|---|
| 9 | 1.5 mg/kg AC006649 | Day 1 SQ Injection | n = 5 |
| 10 | 1.5 mg/kg AC006650 | Day 1 SQ Injection | n = 5 |
| 11 | 1.5 mg/kg AC006651 | Day 1 SQ Injection | n = 5 |
| 12 | 1.5 mg/kg AC006652 | Day 1 SQ Injection | n = 5 |
| 13 | 1.5 mg/kg AC006653 | Day 1 SQ Injection | n = 5 |

The injections were performed between the skin and muscle (i.e. subcutaneous injections) into the loose skin over the neck and shoulder area. Animals were weighed prior to dosing, and the dosing volume was individually adjusted based on the animal body weight.

On Day 15, adipose tissues were harvested from the mice test animals. Inguinal white adipose tissue (iWAT) and perigonadal white adipose tissue (pgWAT) were collected for analysis.

Each of the ALK7 RNAi agents included modified nucleotides that were conjugated at the 5' terminal end and the 3' terminal end of the sense strand to a lipid moiety having the modified sequences as set forth in the duplex structures herein (see Tables 3, 6, 6a, 8, 9, and 10, for specific modifications and structure information related to the ALK7 RNAi agents; see Table 11 for structures of LP-379-a and LP-371-a).

The ALK7 RNAi agents tested in this Example were fully cross-reactive across both human and mouse ALK7.

The adipose biopsies collected from the test animals were used for analysis for ALK7 expression and additional biological parameters. ALK7 mRNA expression levels were quantified via qPCR, using mARL1 as the endogenous control gene, normalized to saline control Group 1. The data are shown in the following Table 39.

TABLE 39

ALK7 expression in mice adipose tissues of Example 17.

| Group ID | Day 15 | | | | | |
|---|---|---|---|---|---|---|
| | iWAT | | | pgWAT | | |
| | Rel Exp ALK7 | Error Low | Error High | Rel Exp ALK7 | Error Low | Error High |
| 1. Saline | 1.000 | 0.277 | 0.383 | 1.000 | 0.194 | 0.241 |
| 2. 1.5 mg/kg AC005824 | 0.266 | 0.055 | 0.069 | 0.277 | 0.050 | 0.062 |
| 3. 1.5 mg/kg AC006643 | 0.348 | 0.034 | 0.037 | 0.296 | 0.063 | 0.081 |
| 4. 1.5 mg/kg AC006644 | 0.355 | 0.051 | 0.059 | 0.317 | 0.040 | 0.046 |
| 5. 1.5 mg/kg AC006645 | 0.366 | 0.058 | 0.069 | 0.321 | 0.064 | 0.079 |
| 6. 1.5 mg/kg AC006646 | 0.365 | 0.076 | 0.096 | 0.344 | 0.034 | 0.038 |
| 7. 1.5 mg/kg AC006647 | 0.222 | 0.057 | 0.076 | 0.175 | 0.059 | 0.088 |
| 8. 1.5 mg/kg AC006648 | 0.246 | 0.038 | 0.045 | 0.170 | 0.046 | 0.063 |
| 9. 1.5 mg/kg AC006649 | 0.246 | 0.060 | 0.079 | 0.223 | 0.034 | 0.040 |
| 10. 1.5 mg/kg AC006650 | 0.313 | 0.070 | 0.091 | 0.318 | 0.086 | 0.119 |
| 11. 1.5 mg/kg AC006651 | 0.317 | 0.048 | 0.057 | 0.343 | 0.075 | 0.096 |
| 12. 1.5 mg/kg AC006652 | 0.387 | 0.076 | 0.094 | 0.367 | 0.054 | 0.063 |
| 13. 1.5 mg/kg AC006653 | 0.318 | 0.043 | 0.049 | 0.364 | 0.063 | 0.076 |

Groups 2-13 showed reduction in ALK7 in mice iWAT and pgWAT at all time points compared to the saline control Group 1. In particular, AC006647 achieved substantial inhibition (0.222, ~78% knockdown) on Day 15 in iWAT after a single subcutaneous administration of 1.5 mg/kg. Additionally, AC006648 achieved substantial inhibition (0.170, ~83% knockdown) on Day 15 in pgWAT after a single subcutaneous administration of 1.5 mg/kg.

Example 18. In Vivo Administration of ALK7 RNAi Agents in Mice

ALK7 RNAi agents were tested in vivo in mice. On Day 1, five (n=5) female C57bl/6 mice in each group were dosed with either isotonic saline or ALK7 RNAi agents formulated in saline (at 1.5 mg/kg), via subcutaneous (SQ) injection, at 250 μL per 25 g body weight injection volume. The dosing regimen is in accordance with Table 40 below.

TABLE 40

Dosing for mice of Example 18.

| Group | Dose (RNAi Agent) | Dosing Route | # of Animals (n=) |
|---|---|---|---|
| 1 | Saline | Day 1 SQ Injection | n = 5 |
| 2 | 1.5 mg/kg AC005824 | Day 1 SQ Injection | n = 5 |
| 3 | 1.5 mg/kg AC007027 | Day 1 SQ Injection | n = 5 |
| 4 | 1.5 mg/kg AC007028 | Day 1 SQ Injection | n = 5 |
| 5 | 1.5 mg/kg AC007029 | Day 1 SQ Injection | n = 5 |
| 6 | 1.5 mg/kg AC007030 | Day 1 SQ Injection | n = 5 |

The injections were performed between the skin and muscle (i.e. subcutaneous injections) into the loose skin over the neck and shoulder area. Animals were weighed prior to dosing, and the dosing volume was individually adjusted based on the animal body weight.

On Day 15, adipose tissues were harvested from the mice test animals. Specifically, inguinal white adipose tissue (iWAT) and perigonadal white adipose tissue (pgWAT) were collected for analysis.

Each of the ALK7 RNAi agents included modified nucleotides that were conjugated at the 5' terminal end and the 3' terminal end of the sense strand to a lipid moiety having the modified sequences as set forth in the duplex structures herein (see Tables 3, 6, 6a, 8, 9, and 10, for specific modifications and structure information related to the ALK7 RNAi agents; see Table 11 for structures of LP-379-a and LP-371-a).

The ALK7 RNAi agents tested in this Example were fully cross-reactive across both human and mouse ALK7.

The adipose biopsies collected from the test animals were used for analysis for ALK7 expression and additional biological parameters. ALK7 mRNA expression levels were quantified via qPCR, using mARL1 as the endogenous control gene, normalized to saline control Group 1. The data are shown in the following Table 41.

TABLE 41

ALK7 expression in mice adipose tissues of Example 18.

| | Day 15 | | | | | |
|---|---|---|---|---|---|---|
| | iWAT | | | pgWAT | | |
| Group ID | Rel Exp ALK7 | Error Low | Error High | Rel Exp ALK7 | Error Low | Error High |
| 1. Saline | 1.000 | 0.190 | 0.234 | 1.000 | 0.201 | 0.252 |
| 2. 1.5 mg/kg AC005824 | 0.395 | 0.094 | 0.124 | 0.250 | 0.062 | 0.083 |
| 3. 1.5 mg/kg AC007027 | 0.394 | 0.090 | 0.117 | 0.293 | 0.084 | 0.118 |
| 4. 1.5 mg/kg AC007028 | 0.377 | 0.107 | 0.149 | 0.342 | 0.089 | 0.121 |
| 5. 1.5 mg/kg AC007029 | 0.326 | 0.077 | 0.101 | 0.321 | 0.096 | 0.136 |
| 6. 1.5 mg/kg AC007030 | 0.262 | 0.043 | 0.051 | 0.299 | 0.102 | 0.154 |

Groups 2-6 showed reduction in ALK7 in mice iWAT and pgWAT at all time points compared to the saline control Group 1. In particular, AC007030 achieved substantial inhibition (0.262, ~74% knockdown) on Day 15 in iWAT after a single subcutaneous administration of 1.5 mg/kg. Additionally, AC005824 achieved substantial inhibition (0.250, ~75% knockdown) on Day 15 in pgWAT after a single subcutaneous administration of 1.5 mg/kg.

Example 19. In Vivo Administration of ALK7 RNAi Agents in Mice

ALK7 RNAi agents were tested in vivo in mice. On Day 1, five (n=5) female C57bl/6 mice in each group were dosed with either isotonic saline or ALK7 RNAi agents formulated in saline (at 1.5 mg/kg), via subcutaneous (SQ) injection, at 250 μL per 25 g body weight injection volume. The dosing regimen is in accordance with Table 42 below.

TABLE 42

Dosing for mice of Example 19.

| Group | Dose (RNAi Agent) | Dosing Route | # of Animals (n=) |
|---|---|---|---|
| 1 | Saline | Day 1 SQ Injection | n = 5 |
| 2 | 1.5 mg/kg AC005823 | Day 1 SQ Injection | n = 5 |
| 3 | 1.5 mg/kg AC006654 | Day 1 SQ Injection | n = 5 |
| 4 | 1.5 mg/kg AC006655 | Day 1 SQ Injection | n = 5 |
| 5 | 1.5 mg/kg AC006656 | Day 1 SQ Injection | n = 5 |
| 6 | 1.5 mg/kg AC006657 | Day 1 SQ Injection | n = 5 |
| 7 | 1.5 mg/kg AC006658 | Day 1 SQ Injection | n = 5 |
| 8 | 1.5 mg/kg AC006659 | Day 1 SQ Injection | n = 5 |
| 9 | 1.5 mg/kg AC006660 | Day 1 SQ Injection | n = 5 |
| 10 | 1.5 mg/kg AC006661 | Day 1 SQ Injection | n = 5 |
| 11 | 1.5 mg/kg AC006662 | Day 1 SQ Injection | n = 5 |
| 12 | 1.5 mg/kg AC006663 | Day 1 SQ Injection | n = 5 |
| 13 | 1.5 mg/kg AC006664 | Day 1 SQ Injection | n = 5 |
| 14 | 1.5 mg/kg AC006665 | Day 1 SQ Injection | n = 5 |

The injections were performed between the skin and muscle (i.e. subcutaneous injections) into the loose skin over the neck and shoulder area. Animals were weighed prior to dosing, and the dosing volume was individually adjusted based on the animal body weight.

On Day 15, adipose tissues were harvested from the mice test animals. Specifically, inguinal white adipose tissue (iWAT) and perigonadal white adipose tissue (pgWAT) were collected for analysis.

Each of the ALK7 RNAi agents included modified nucleotides that were conjugated at the 5' terminal end and the 3' terminal end of the sense strand to a lipid moiety having the modified sequences as set forth in the duplex structures herein (see Tables 3, 6, 6a, 8, 9, and 10, for specific modifications and structure information related to the ALK7 RNAi agents; see Table 11 for structures of LP-379-a and LP-371-a).

The ALK7 RNAi agents tested in this Example were fully cross-reactive across both human and mouse ALK7 genes.

The adipose biopsies collected from the test animals were used for analysis for ALK7 expression and additional biological parameters. ALK7 mRNA expression levels were quantified via qPCR, using mARL1 as the endogenous control gene, normalized to saline control Group 1. The data are shown in the following Table 43.

TABLE 43

ALK7 expression in mice adipose tissues of Example 19.

| | Day 15 | | | | | |
|---|---|---|---|---|---|---|
| | iWAT | | | pgWAT | | |
| Group ID | Rel Exp ALK7 | Error Low | Error High | Rel Exp ALK7 | Error Low | Error High |
| 1. Saline | 1.000 | 0.215 | 0.273 | 1.000 | 0.206 | 0.259 |
| 2. 1.5 mg/kg AC005823 | 0.379 | 0.053 | 0.061 | 0.235 | 0.036 | 0.043 |
| 3. 1.5 mg/kg AC006654 | 0.359 | 0.086 | 0.113 | 0.279 | 0.033 | 0.037 |
| 4. 1.5 mg/kg AC006655 | 0.266 | 0.067 | 0.090 | 0.238 | 0.073 | 0.106 |
| 5. 1.5 mg/kg AC006656 | 0.300 | 0.044 | 0.052 | 0.329 | 0.056 | 0.067 |
| 6. 1.5 mg/kg AC006657 | 0.297 | 0.048 | 0.057 | 0.282 | 0.028 | 0.031 |
| 7. 1.5 mg/kg AC006658 | 0.301 | 0.053 | 0.064 | 0.291 | 0.062 | 0.079 |
| 8. 1.5 mg/kg AC006659 | 0.273 | 0.052 | 0.064 | 0.299 | 0.182 | 0.463 |
| 9. 1.5 mg/kg AC006660 | 0.292 | 0.041 | 0.048 | 0.260 | 0.059 | 0.077 |
| 10. 1.5 mg/kg AC006661 | 0.272 | 0.073 | 0.100 | 0.223 | 0.057 | 0.077 |
| 11. 1.5 mg/kg AC006662 | 0.289 | 0.046 | 0.055 | 0.269 | 0.073 | 0.100 |
| 12. 1.5 mg/kg AC006663 | 0.220 | 0.047 | 0.059 | 0.243 | 0.069 | 0.097 |
| 13. 1.5 mg/kg AC006664 | 0.278 | 0.070 | 0.093 | 0.420 | 0.090 | 0.115 |
| 14. 1.5 mg/kg AC006665 | 0.344 | 0.056 | 0.068 | 0.405 | 0.041 | 0.045 |

Groups 2-14 showed reduction in ALK7 in mice iWAT and pgWAT at all time points compared to the saline control Group 1. In particular, AC006663 achieved substantial inhibition (0.220, ~78% knockdown) on Day 15 in iWAT after a single subcutaneous administration of 1.5 mg/kg. Additionally, AC006661 achieved substantial inhibition (0.223, ~78% knockdown) on Day 15 in pgWAT after a single subcutaneous administration of 1.5 mg/kg.

Example 20. In Vivo Administration of ALK7 RNAi Agents in DIO Mice with GLP-1 Agonist ALK7 RNAi agents, GLP-1 agonists and combinations thereof were tested in an obese mouse DIO mouse model. Mice were dosed according to the dosing groups shown in Table 44, below.

TABLE 44

Dosing groups for mice of Example 20.

| Group | Dose (RNAi Agent) | Dosing Route | # of Animals (n=) |
|---|---|---|---|
| 1 | Saline | Weekly SQ administration | n = 10 |
| 2 | 3 mg/kg AC005181 | Weekly SQ administration | n = 10 |
| 3 | 3 mg/kg AC005181, 0.21 mpk tirzepatide | Weekly SQ administration of AC005181, daily administration of tirzepatide | n = 10 |
| 4 | 3 mg/kg AC005181, 0.14 mpk tirzepatide | Weekly SQ administration of AC005181, daily administration of tirzepatide | n = 10 |
| 5 | 3 mg/kg AC005181, 0.07 mpk tirzepatide | Weekly SQ administration of AC005181, daily administration of tirzepatide | n = 10 |
| 6 | 0.21 mpk tirzepatide | Daily administration | n = 10 |
| 7 | 0.14 mpk tirzepatide | Daily administration | n = 10 |
| 8 | 0.07 mpk tirzepatide | Daily administration | n = 10 |

Figure 1B:
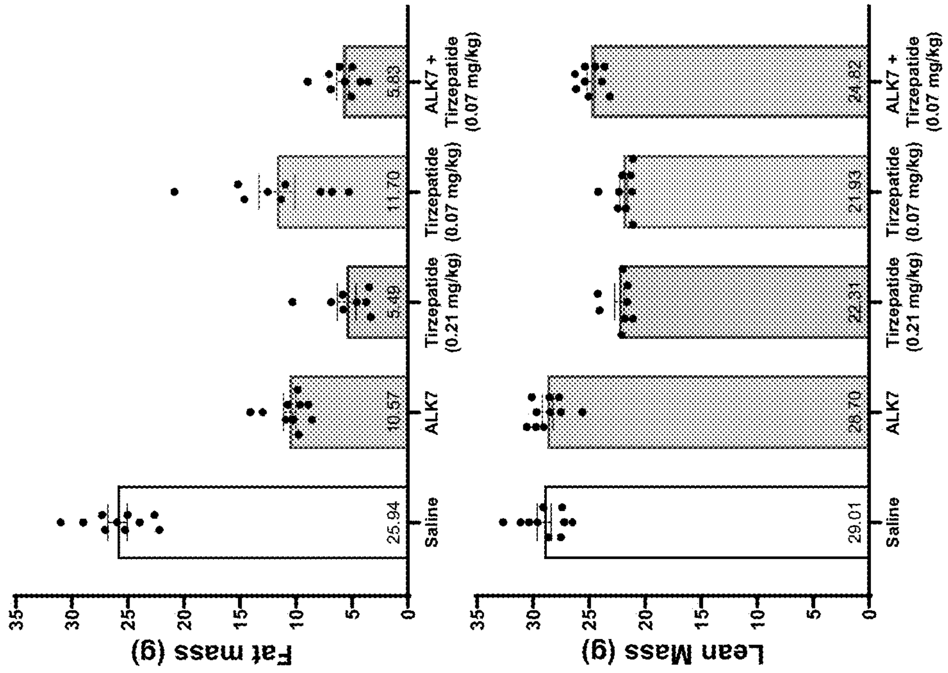
FIG. 1B shows the body composition of mice administered a control formulation, RNAi agent, GLP1 agonist, or combination thereof according to Example 20.
Figure 2:
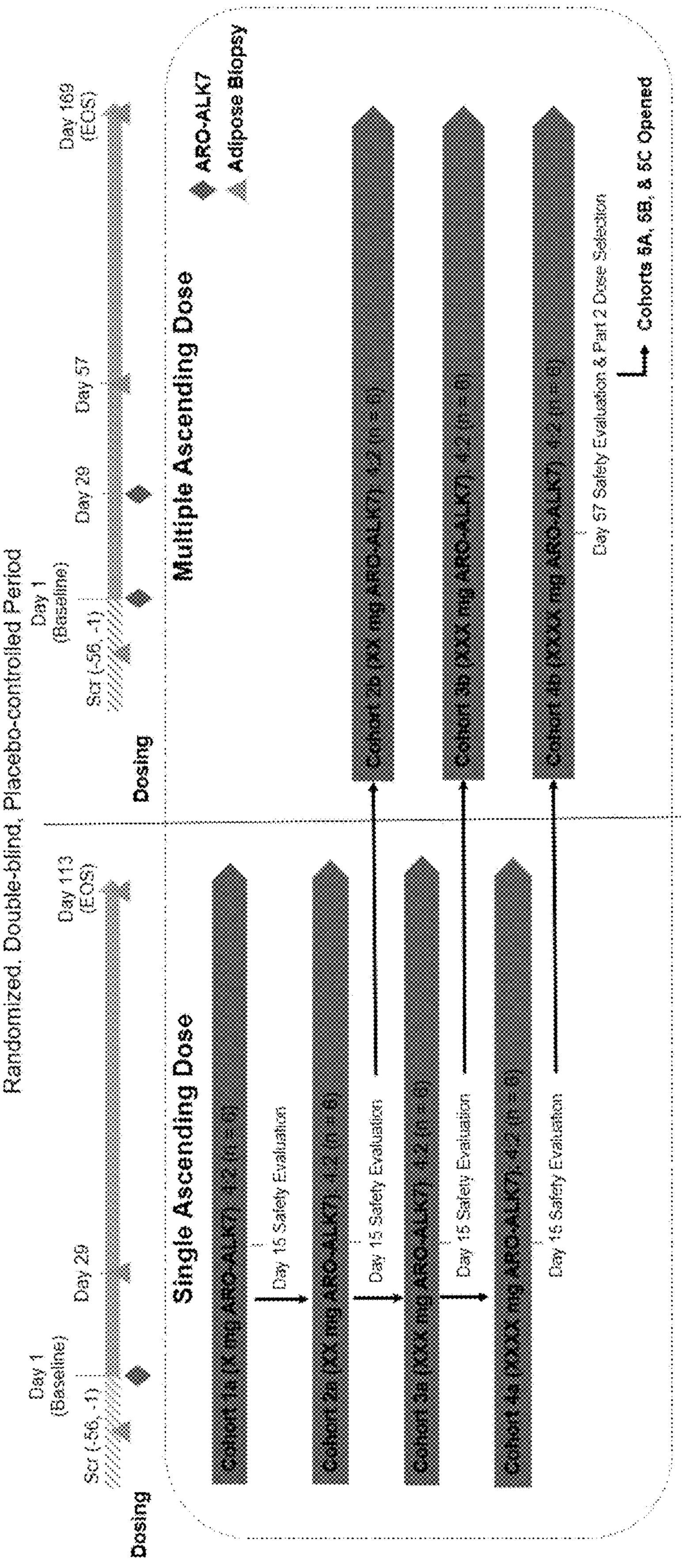
FIG. 2 shows a Proposed Clinical Study Schema for Part 1 (Cohorts 1-4) of a Phase 1/2a dose-escalating study to evaluate the safety, tolerability, pharmacokinetics, and pharmacodynamics of single and multiple doses of an ALK7 RNAi agent, showing dosing for adult volunteers with obesity (see Example 21 herein). "ARO-ALK7" represents an ALK7 RNAi agent-conjugate in accordance with the disclosure herein.

AC005181 is an RNAi agent specific to mouse ALK7. On study day-22, body weights for each animal were measured, and body weight for each animal was measured weekly thereafter. On study days −22, 29, 57, 85, 113, and 141, animals were fasted for 6 hours before being bled to collect serum. Animals were harvested on study day 152. Average body weights for groups 2, 5, 6 and 8 are shown in FIG. 1A. Body composition for groups 2, 5, 6 and 8 at day 152 are shown in FIG. 1B.

These data demonstrate that co-administration of an ALK7 RNAi agent with a GLP-1 agonist such as tirzepatide may be more effective than either therapeutic alone in reducing body weight. Furthermore, a smaller dose of a GLP-1 agonist in combination with an ALK7 RNAi agent may be effective at retaining more lean mass (muscle) while reducing fat mass.

Example 21. In Vivo Administration of an ALK7 RNAi Agent in Cynomolgus Monkeys ALK7 RNAi agents were tested in Cynomolgus monkeys for inhibition of ALK7. On Day 1, four (n=4) male Cynomolgus monkeys for each test group were dosed with ALK7 RNAi agents formulated in saline (at 0.75, 1.5, or 3.0 mg/kg), via subcutaneous (SQ) injection with syringe and needle in the mid-scapular region, at 0.3 mL/kg dose volume. Adipose biopsies were collected from all test animals on Day −12 (pre-dose), 15, 29, 57, 85, 113, 141, and 169. The dosing regimen was in accordance with Table 45 below.

TABLE 45

Dosing for test animals of Example 21.

| Group | Study Material | # of Animals | Dosing Route | Dose Volume |
|---|---|---|---|---|
| 1 | Saline | n = 4 | Day 1 SQ Injection | 0.3 mL/kg |
| 2 | 0.75 mg/kg AC006188 | n = 4 | Day 1 SQ Injection | 0.3 mL/kg |
| 3 | 1.5 mg/kg AC006188 | n = 4 | Day 1 SQ Injection | 0.3 mL/kg |
| 4 | 3.0 mg/kg AC006188 | n = 4 | Day 1 SQ Injection | 0.3 mL/kg |

All animals were fasted for at least 12 hours but less than 18 hours for scheduled blood collections and biopsy procedures. Blood collection site was femoral vein. A saphenous vein (not used for dose administration) may be used as an alternative collection site.

Adipose biopsies were collected as a sedated procedure. Sedation was accomplished using Telazol (4-8 mg/kg), administered as an intramuscular (IM) injection and supplemented with Ketamine (~5 mg/kg) as needed.

An approximate 3-5 cm skin incision was made followed by collection of adipose tissue (optimally 50-150 mg). The skin will then be closed in a routine manner using suture (or alternate) materials maintaining aseptic technique.

Each biopsy site was separated by at least 1-2 cm. Biopsies were separated into 2 pieces (one piece of ~25 to 75 mg and second piece of ~25-75 mg) for each collection time point. Analgesics may be administered at veterinarian's discretion.

Blood was collected into tubes containing no anticoagulant (serum separator tubes). Blood was allowed to clot at ambient temperature prior to centrifugation to obtain serum.

Blood was collected on Day −12, 1, 15, 29, 57, 85, 113, 141, and 169 prior to biopsy sample collections or dose administration (when applicable), and from any animals found in moribund condition or sacrificed at an unscheduled interval. Samples may be further collected at additional timepoints. Should there be any additional collected samples at other timepoints, their corresponding relevant data are shown below.

Individual doses of ALK7 RNAi agents were calculated based on the body weights recorded on each day of dosing.

The adipose biopsies and serum collected from the test animals were used for analysis for ALK7 expression and additional biological parameters. ALK7 mRNA expression levels in WAT (from biopsy) were quantified via qPCR, using cARL1 as the endogenous control gene, normalized to Day −12 pre-dose. Results from the WAT tissue biopsy knockdown are shown in Table 46, below.

Each of the ALK7 RNAi agents included modified nucleotides that were conjugated at the 5' terminal end and the 3' terminal end of the sense strand to a lipid moiety having the modified sequences as set forth in the duplex structures herein (see Tables 3, 6, 6a, 8, 9, and 10, for specific modifications and structure information related to the ALK7 RNAi agent; see Table 11 for structures of LP-379-a and LP-371-a).

TABLE 46

Average expression of ALK7 in cynomolgus monkeys in WAT relative to saline control, of Example 21.

| Group ID | Day 15 Rel. Exp. cALK7 | Day 15 Error Low | Day 15 Error High | Day 29 Rel. Exp. cALK7 | Day 29 Error Low | Day 29 Error High |
|---|---|---|---|---|---|---|
| 1. Saline | 1.423 | 0.606 | 1.057 | 0.981 | 0.726 | 2.795 |
| 2. 0.75 mg/kg AC006188 | 0.207 | 0.095 | 0.175 | 0.161 | 0.066 | 0.111 |
| 3. 1.5 mg/kg AC006188 | 0.095 | 0.054 | 0.124 | 0.150 | 0.048 | 0.071 |
| 4. 3.0 mg/kg AC006188 | 0.154 | 0.070 | 0.130 | 0.111 | 0.034 | 0.049 |

| Group ID | Day 57 Rel. Exp. cALK7 | Day 57 Error Low | Day 57 Error High | Day 85 Rel. Exp. cALK7 | Day 85 Error Low | Day 85 Error High |
|---|---|---|---|---|---|---|
| 1. Saline | 2.031 | 0.762 | 1.220 | 1.731 | 0.614 | 0.952 |
| 2. 0.75 mg/kg AC006188 | 0.224 | 0.061 | 0.083 | 0.205 | 0.048 | 0.063 |
| 3. 1.5 mg/kg AC006188 | 0.221 | 0.067 | 0.095 | 0.251 | 0.099 | 0.165 |
| 4. 3.0 mg/kg AC006188 | 0.189 | 0.026 | 0.030 | 0.214 | 0.067 | 0.097 |

| Group ID | Day 113 Rel. Exp. cALK7 | Day 113 Error Low | Day 113 Error High | Day 134 Rel. Exp. cALK7 | Day 134 Error Low | Day 134 Error High |
|---|---|---|---|---|---|---|
| 1. Saline | 2.511 | 0.862 | 1.312 | 1.902 | 0.727 | 1.177 |
| 2. 0.75 mg/kg AC006188 | 0.236 | 0.072 | 0.104 | ND* | ND* | ND* |
| 3. 1.5 mg/kg AC006188 | 0.350 | 0.037 | 0.042 | ND* | ND* | ND* |
| 4. 3.0 mg/kg AC006188 | 0.312 | 0.135 | 0.239 | 0.328 | 0.134 | 0.226 |

TABLE 46-continued

Average expression of ALK7 in cynomolgus monkeys in WAT relative to saline control, of Example 21.

| Group ID | Day 141 Rel. Exp. cALK7 | Day 141 Error Low | Day 141 Error High | Day 169 Rel. Exp. cALK7 | Day 169 Error Low | Day 169 Error High |
|---|---|---|---|---|---|---|
| 1. Saline | ND* | ND* | ND* | ND* | ND* | ND* |
| 2. 0.75 mg/kg AC006188 | 0.898 | 0.455 | 0.922 | 0.331 | 0.107 | 0.158 |
| 3. 1.5 mg/kg AC006188 | 0.552 | 0.224 | 0.378 | 0.397 | 0.082 | 0.104 |
| 4. 3.0 mg/kg AC006188 | ND* | ND* | ND* | ND* | ND* | ND* |

*Groups 1 and 4 were terminated on Day 134. Groups 2 and 3 continued with the planned collection days.

ALK7 RNAi agent AC006188 achieved inhibition of ALK7 at all time points. A dose-response was observed at Day 29, 57, and 141. These data show a generally dose-dependent knockdown of ALK7 with AC006188, with expression of ALK7 being inhibited at all dose levels even as long as Day 169 from a single dose.

Example 22. Phase 1/2A Clinical Study of ALK7 RNAi Agents in Adult Volunteers with Obesity with and without Type 2 Diabetes Mellitus ALK7 RNAi agents will be tested in human clinical trials.

Figure 3:
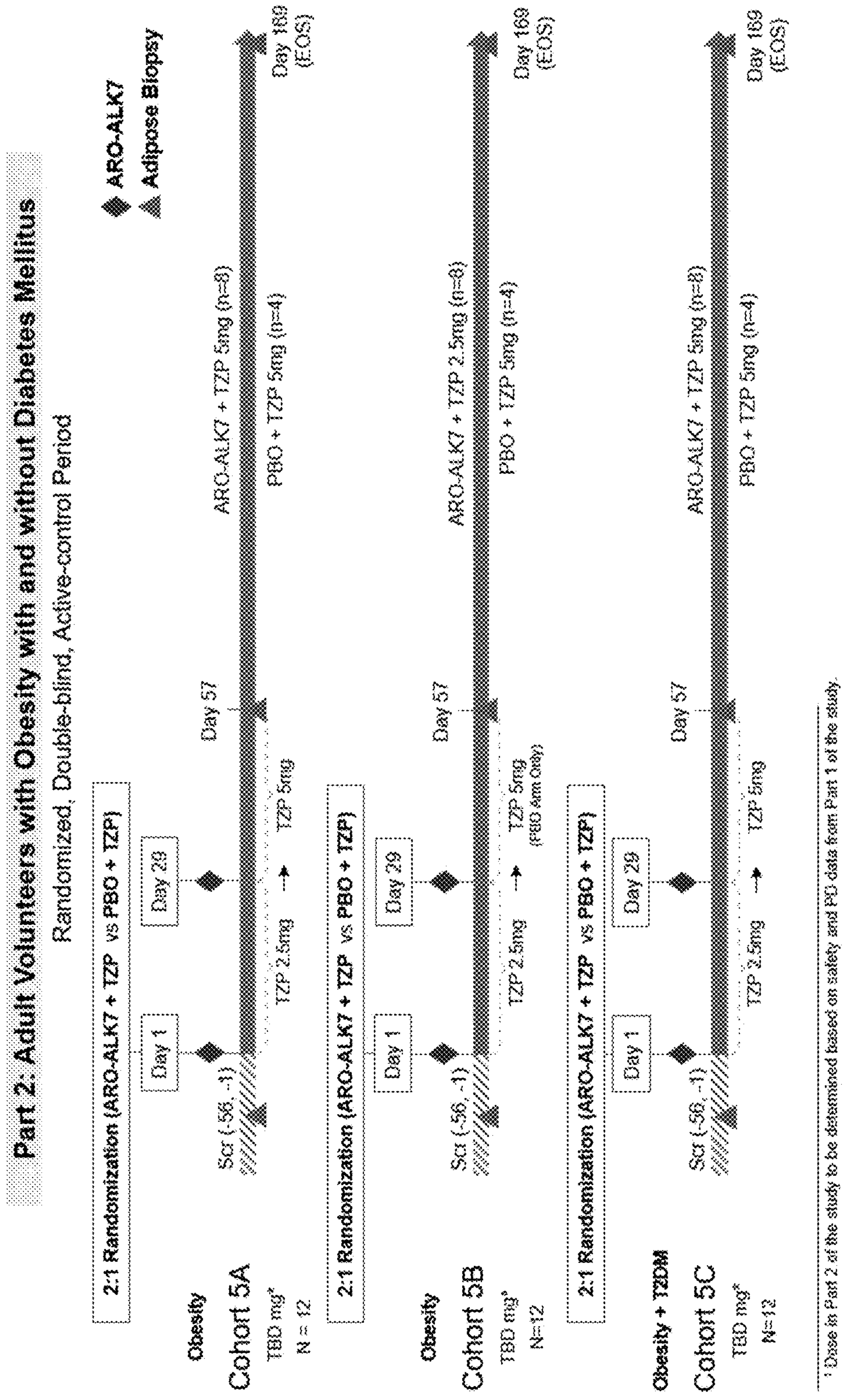
FIG. 3 shows Proposed Clinical Study Schema for Part 2 of a Phase 1/2a dose-escalating study to evaluate the safety, tolerability, and pharmacodynamics of repeat doses of an ALK7 RNAi agent in combination with a GLP-1/GIP agonist (tirzepatide (TZP)), showing dosing for adult volunteers with obesity with and without type 2 diabetes mellitus (see Example 21 herein). "ARO-ALK7" represents an ALK7 RNAi agent-conjugate in accordance with the disclosure herein.
Figure 4A:
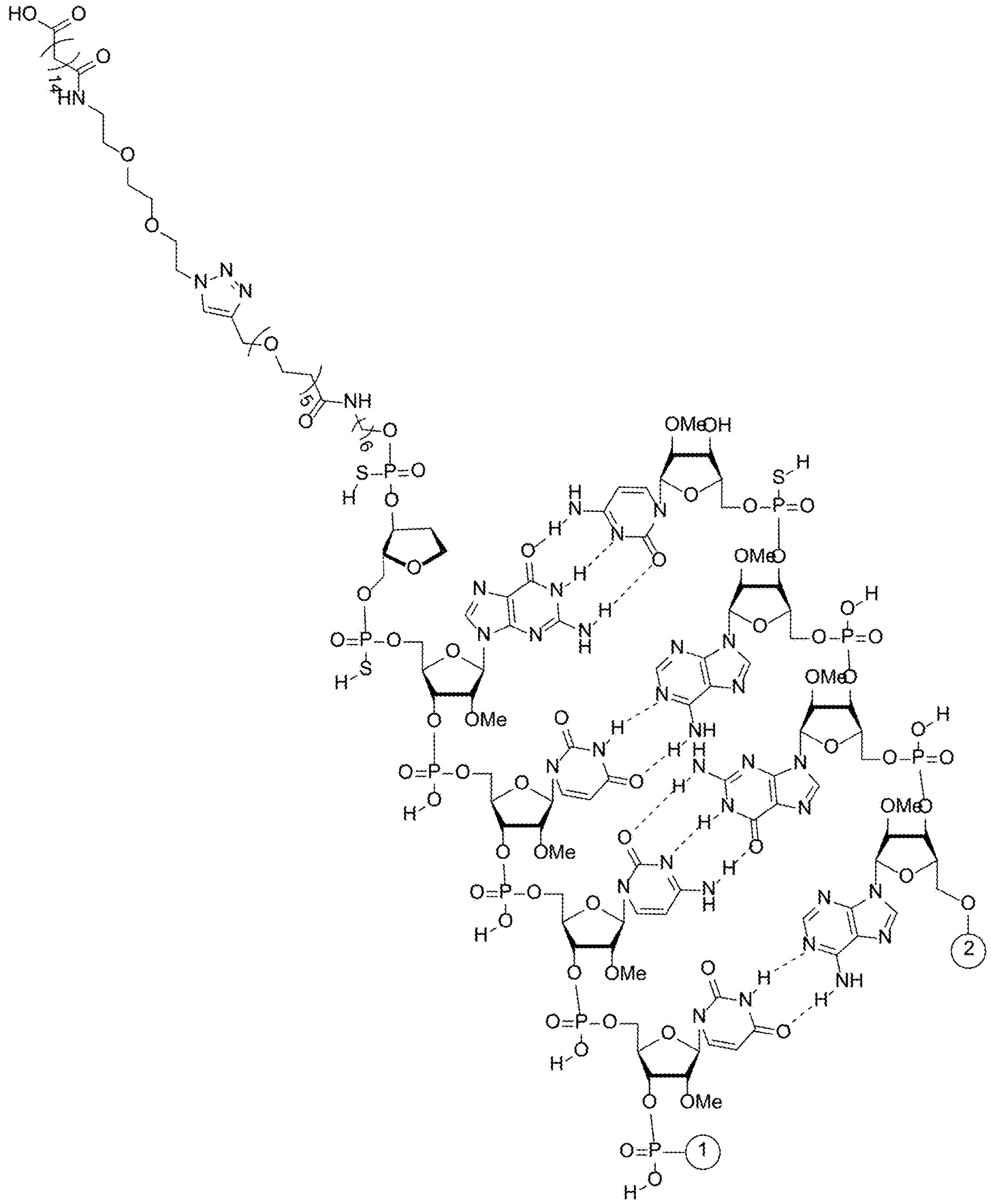
FIGS. 4A-4D show a chemical structure representation of ALK7 RNAi agent AC006188 (SEQ ID NOs: 269/535), shown with PK/PD modulators linked to the 5' and 3' ends of the sense strand, shown as a free acid.
Figure 4B:
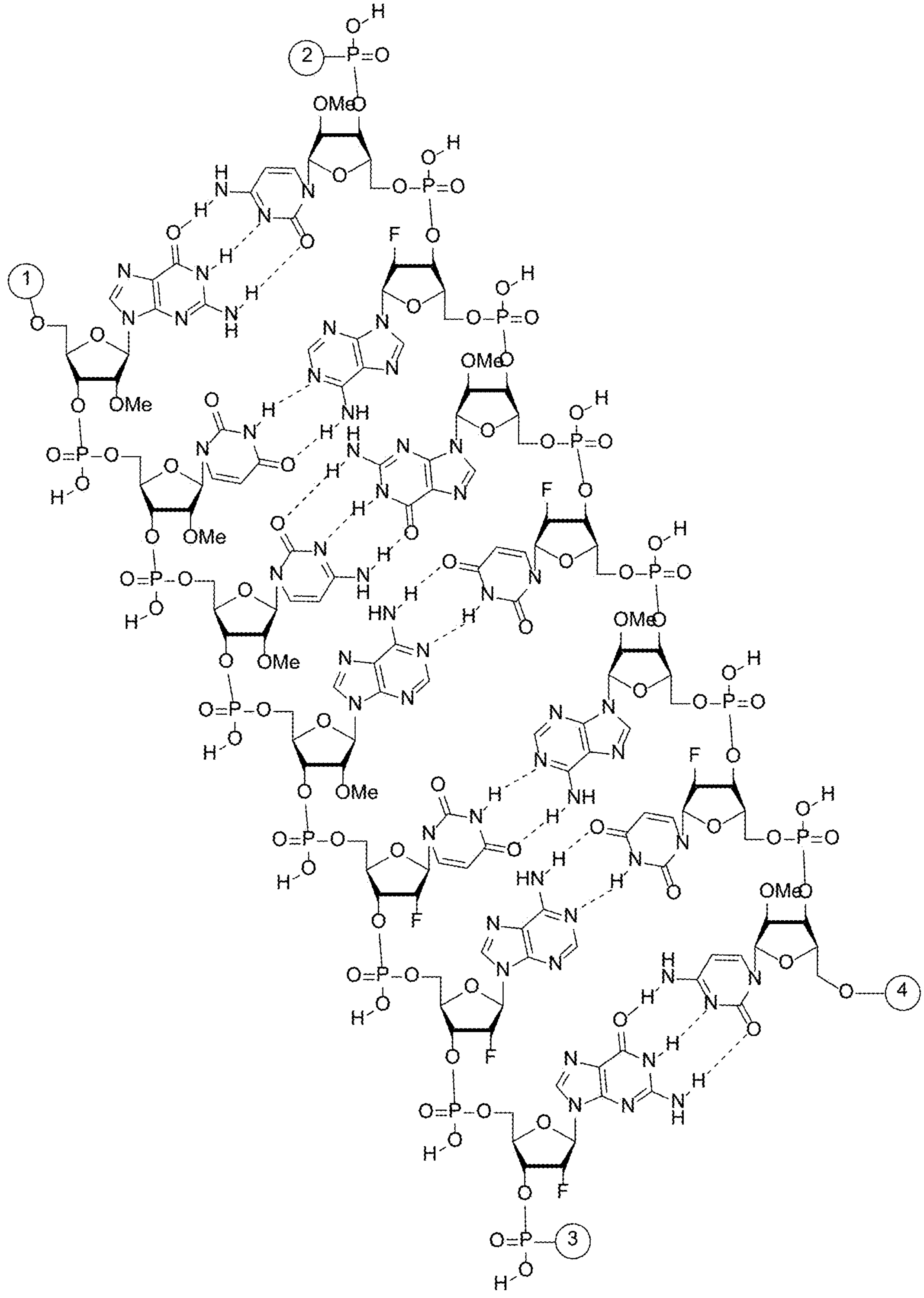
Figure 4C:
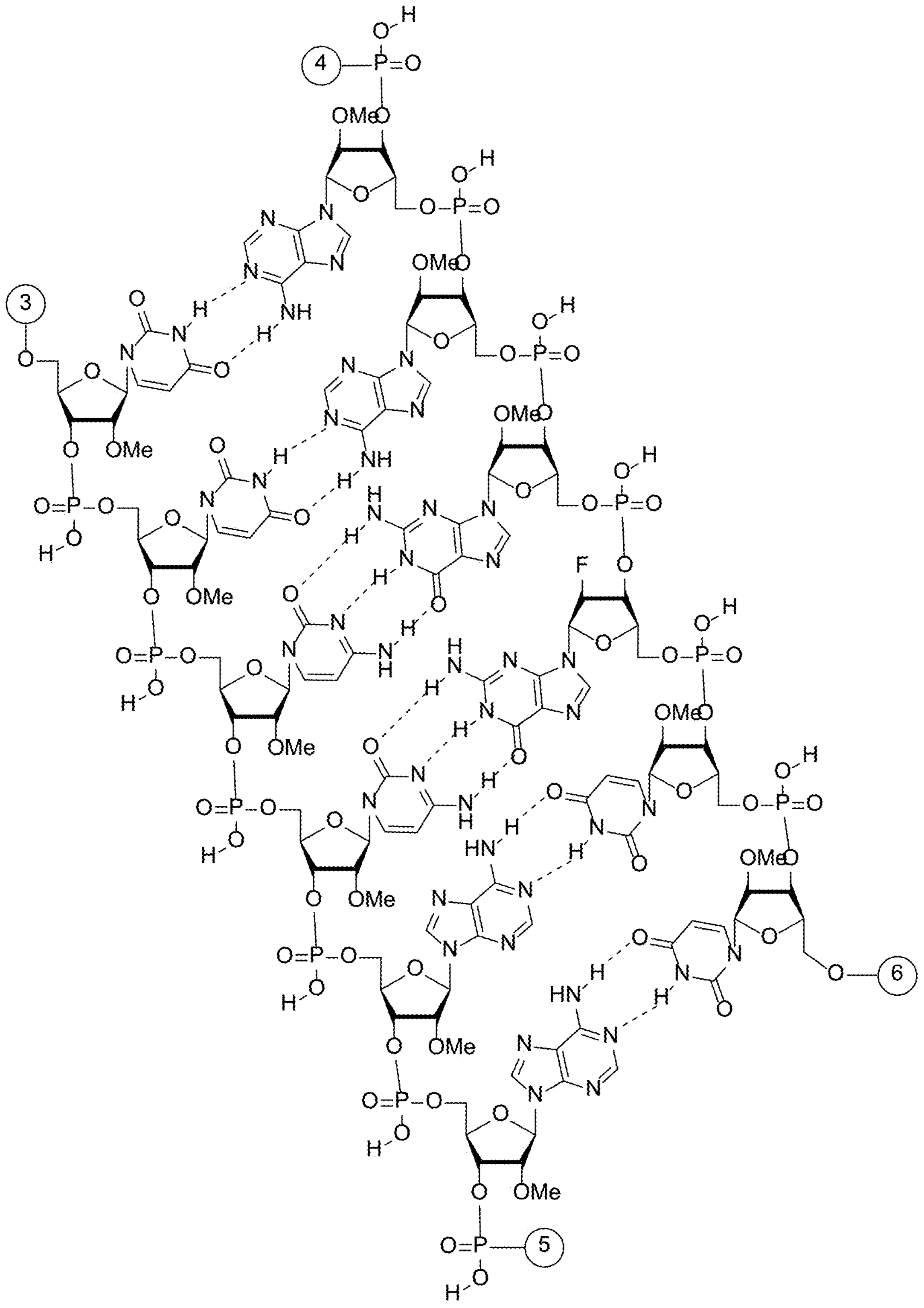
Figure 4D:
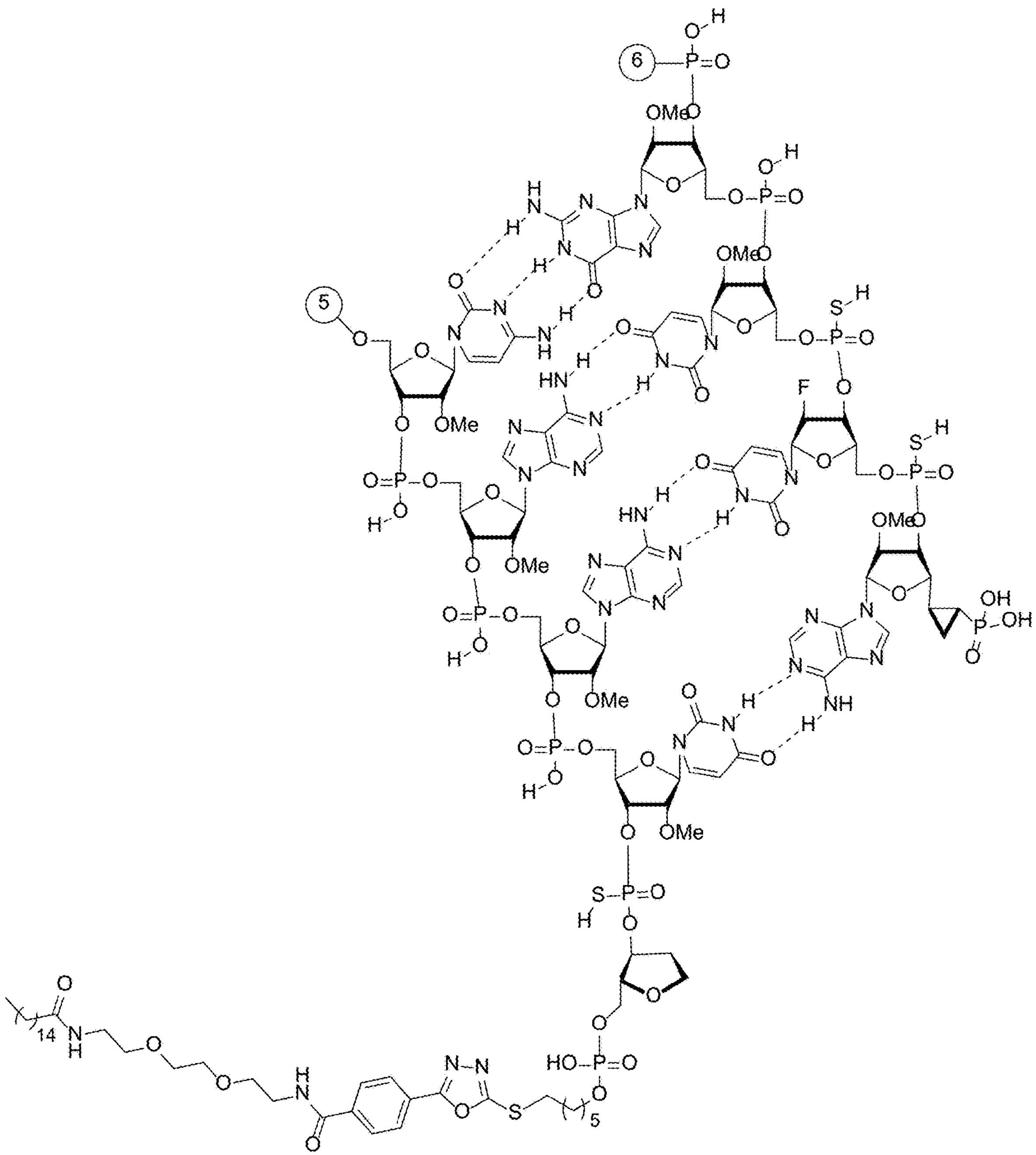
Figure 5A:
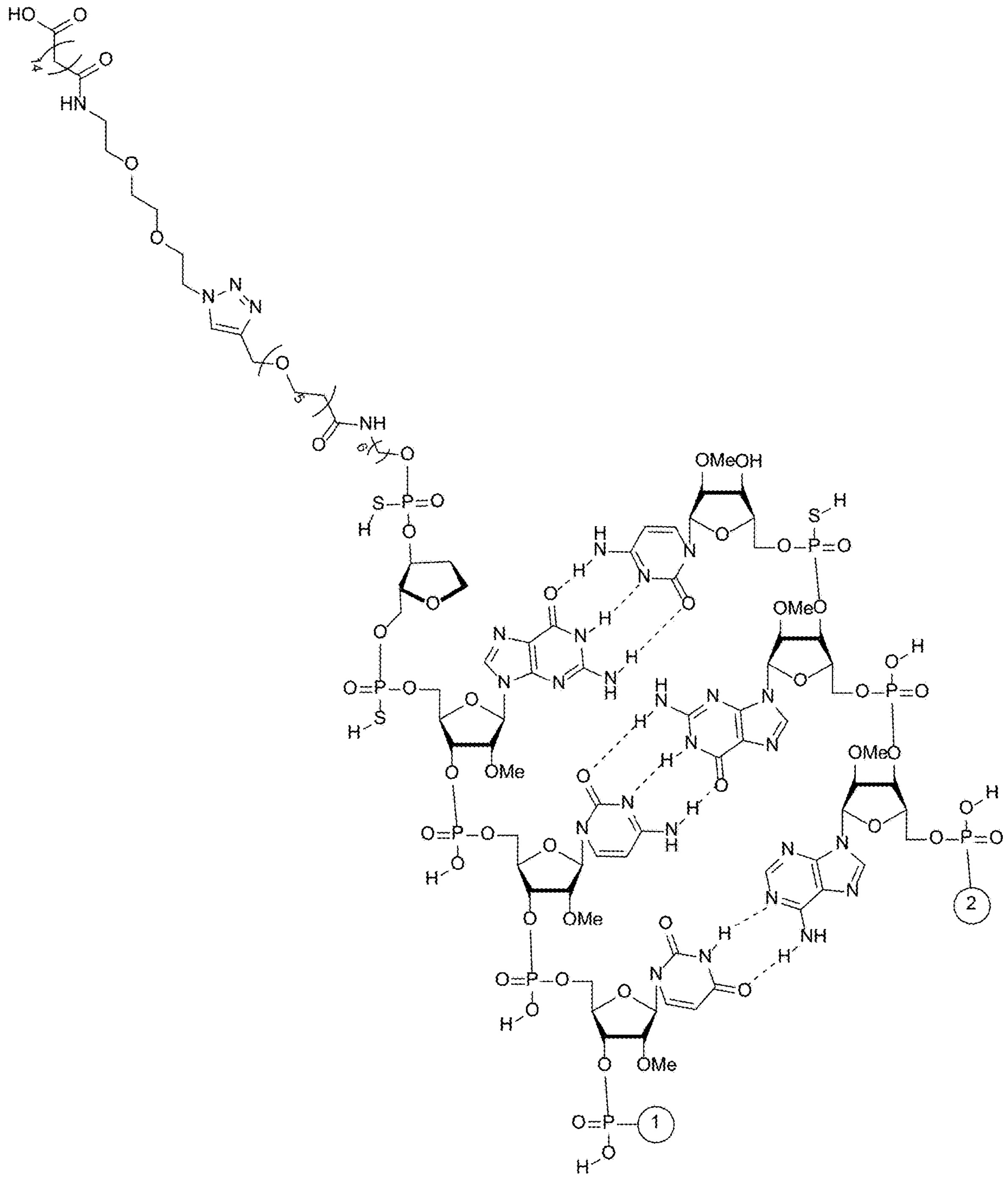
FIGS. 5A-5D show a chemical structure representation of ALK7 RNAi agent AC006189 (SEQ ID NOs: 270/536), shown with PK/PD modulators linked to the 5' and 3' ends of the sense strand, shown as a free acid.
Figure 5B:
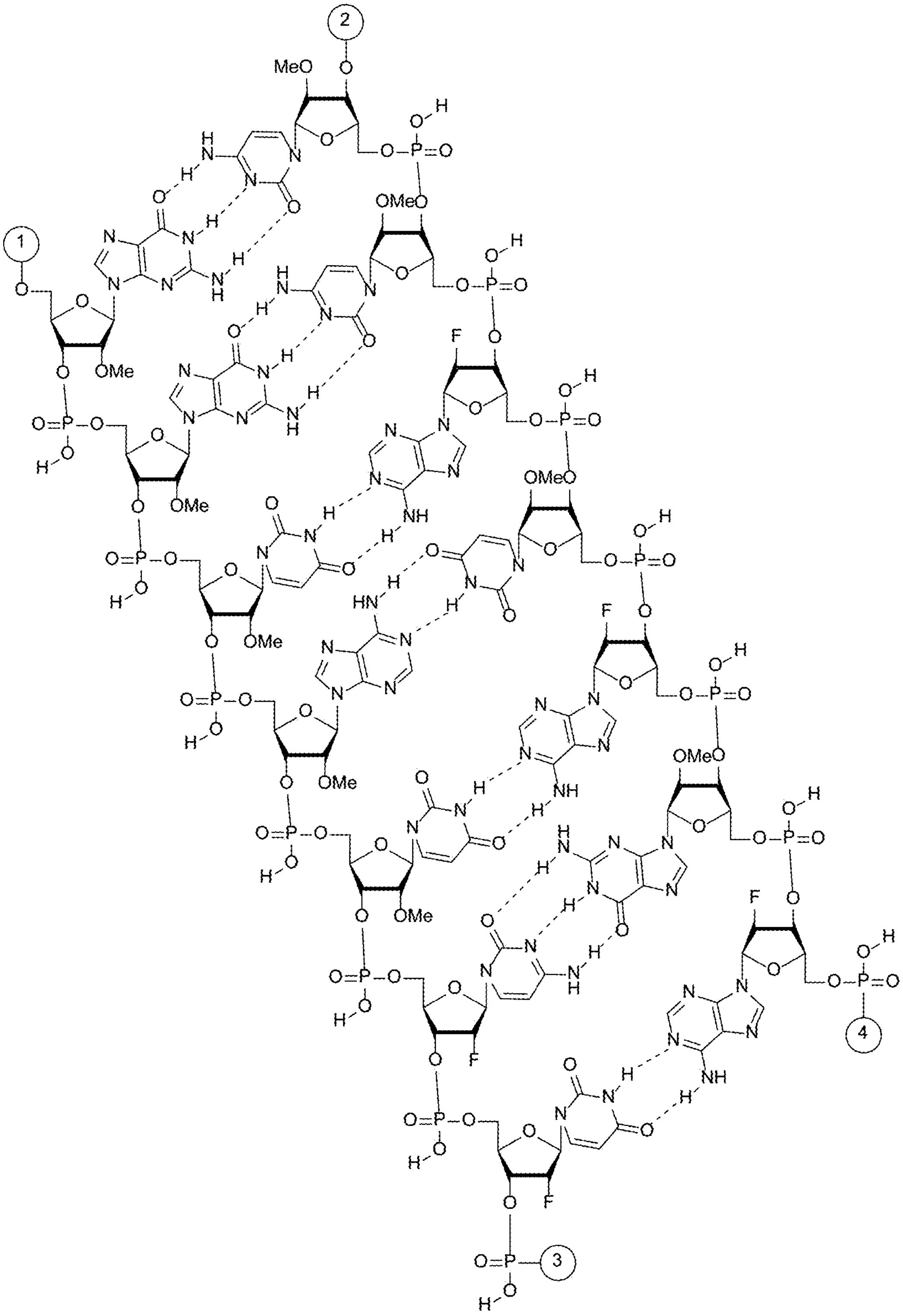
Figure 5C:
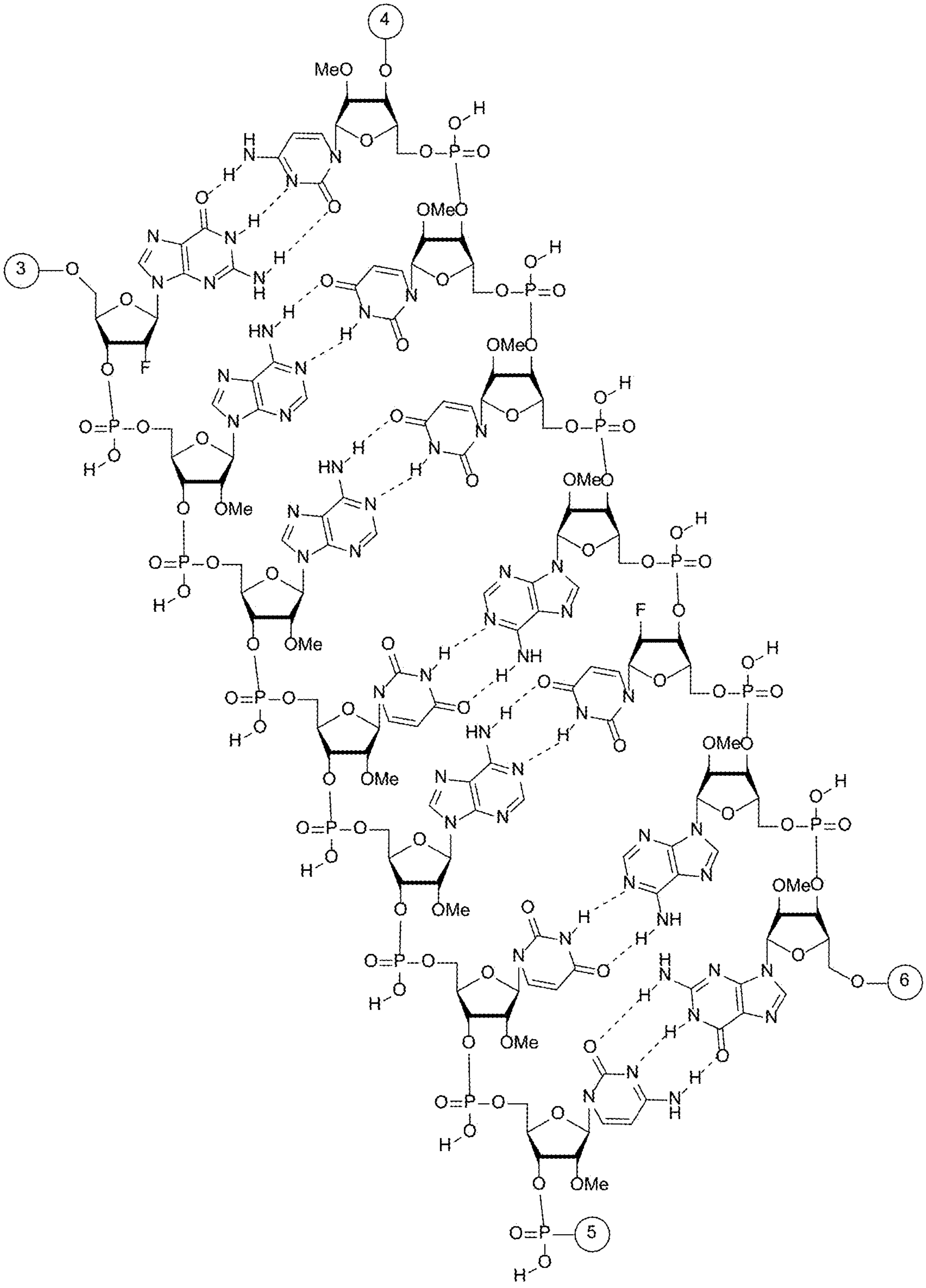
Figure 5D:
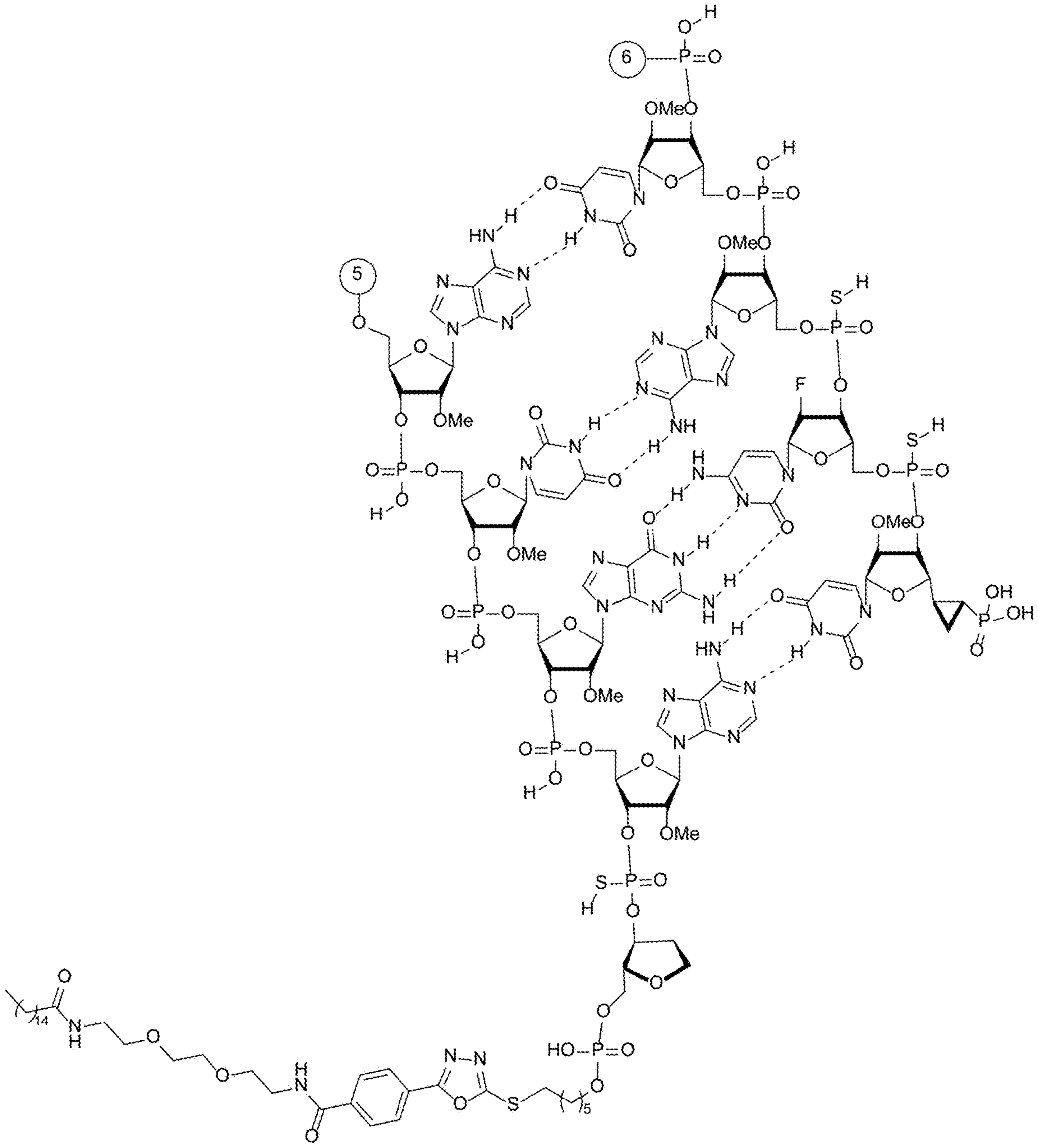
Figure 6A:
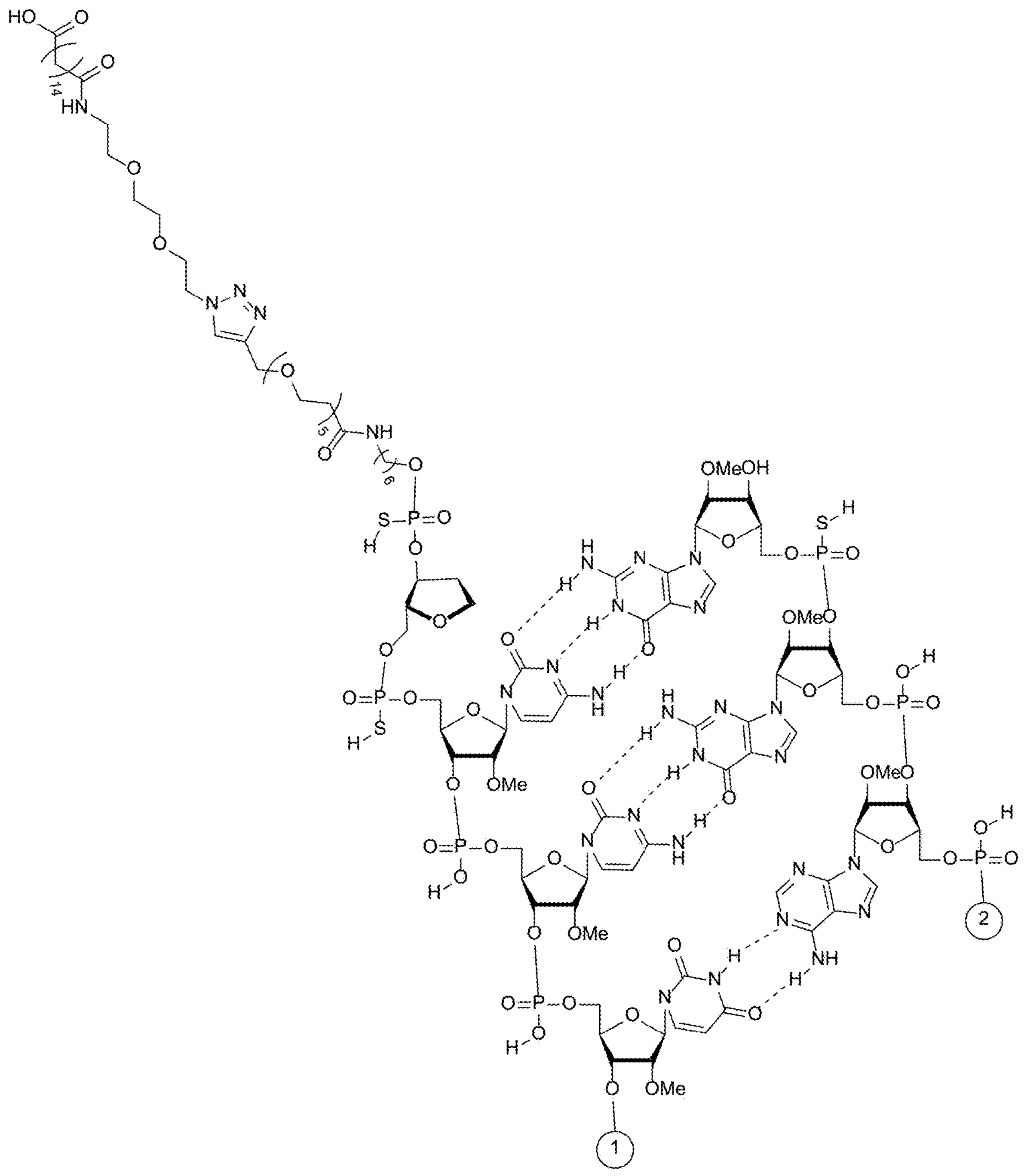
FIGS. 6A-6D show a chemical structure representation of ALK7 RNAi agent AC006648 (SEQ ID NOs: 320/534), shown with PK/PD modulators linked to the 5' and 3' ends of the sense strand, shown as a free acid.
Figure 6B:
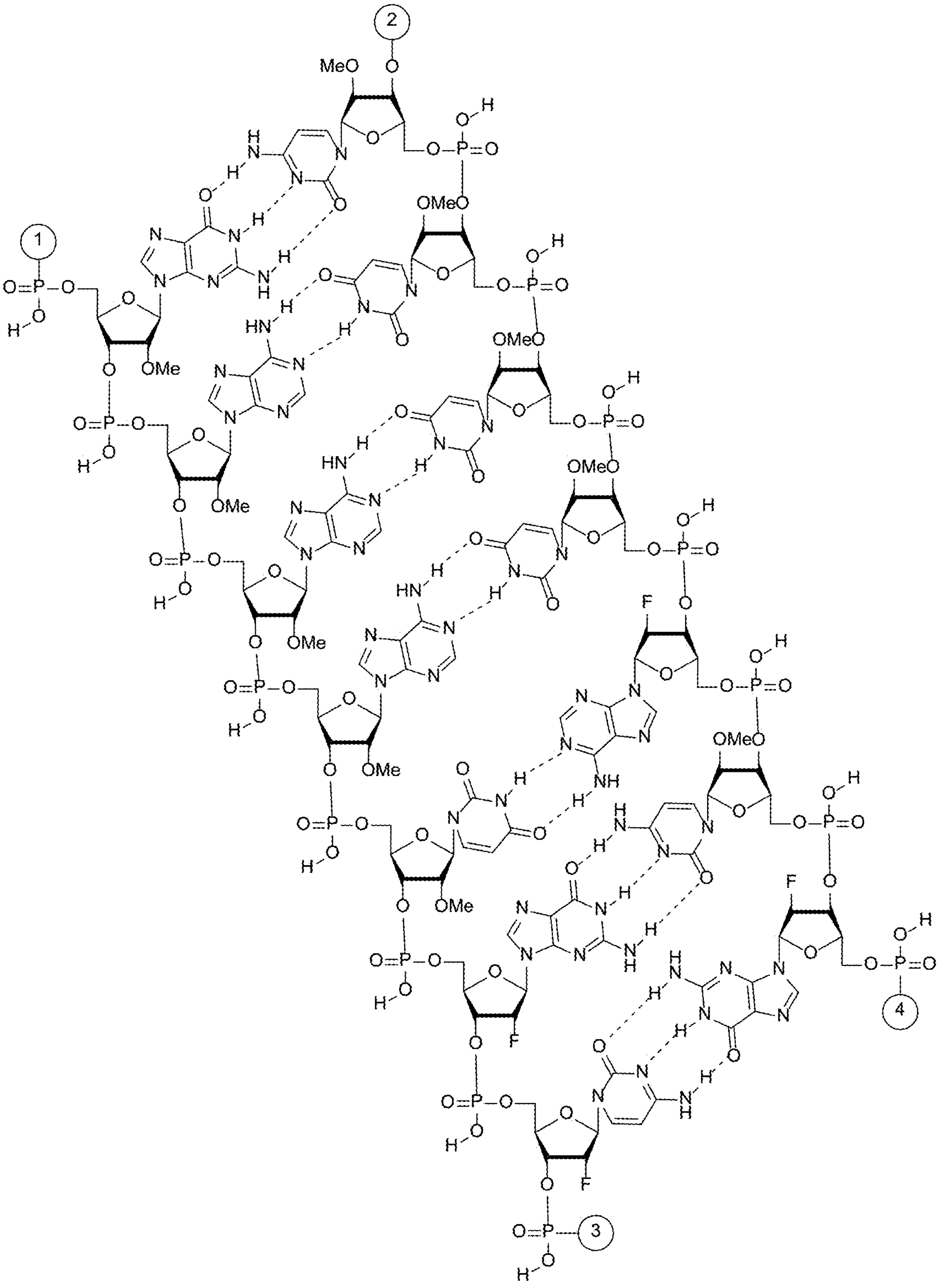
Figure 6C:
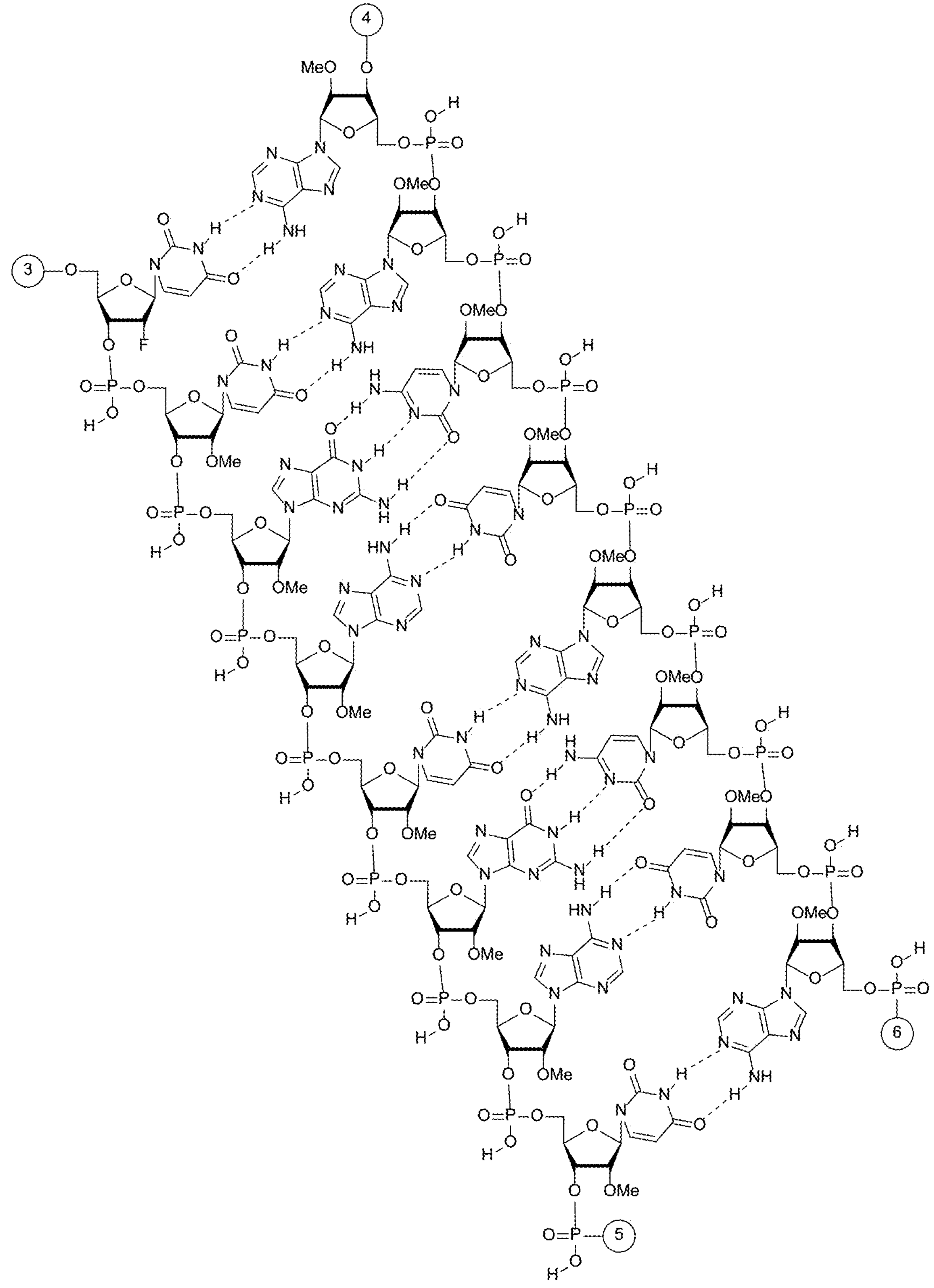
Figure 6D:
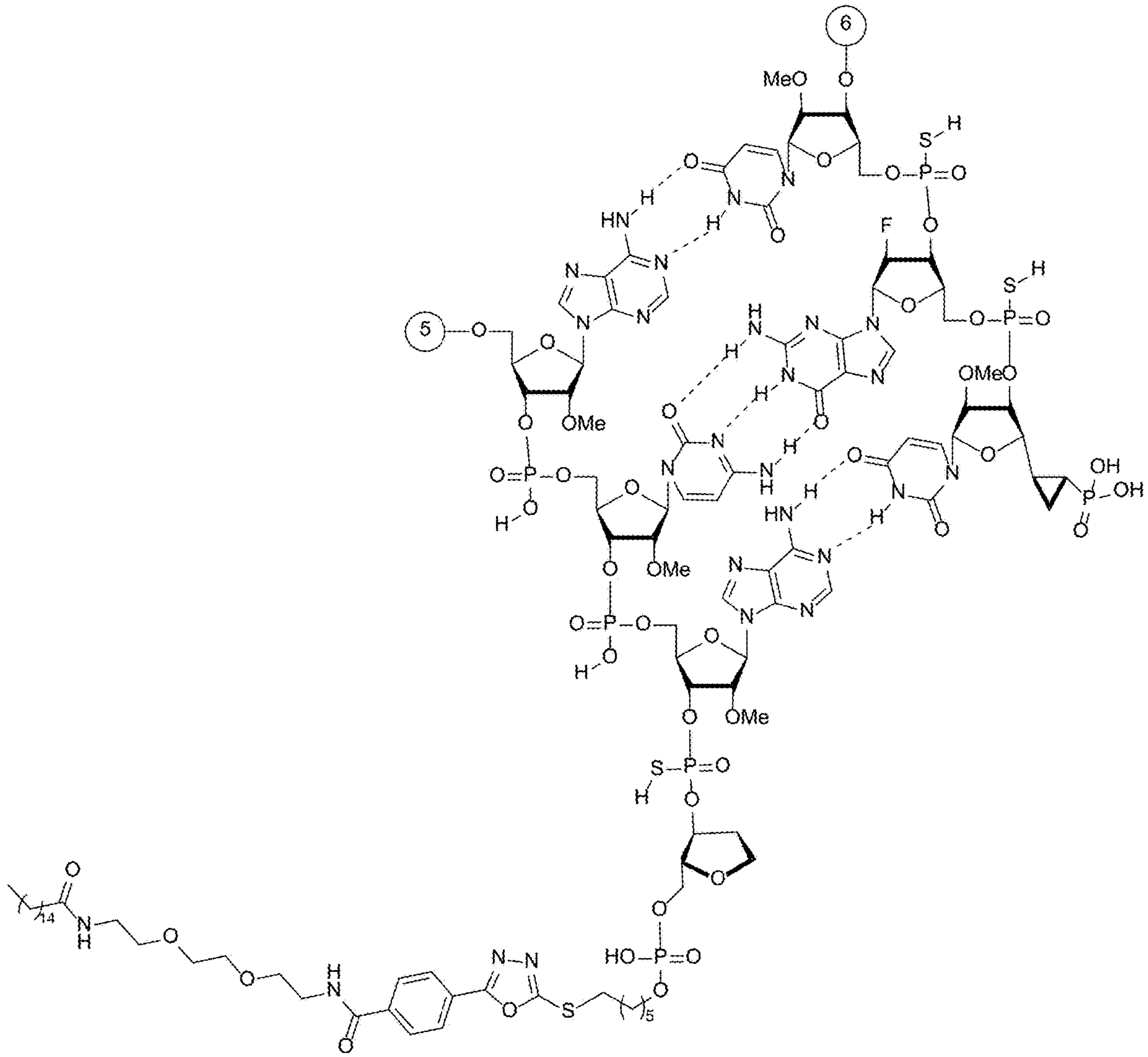
Figure 7A:
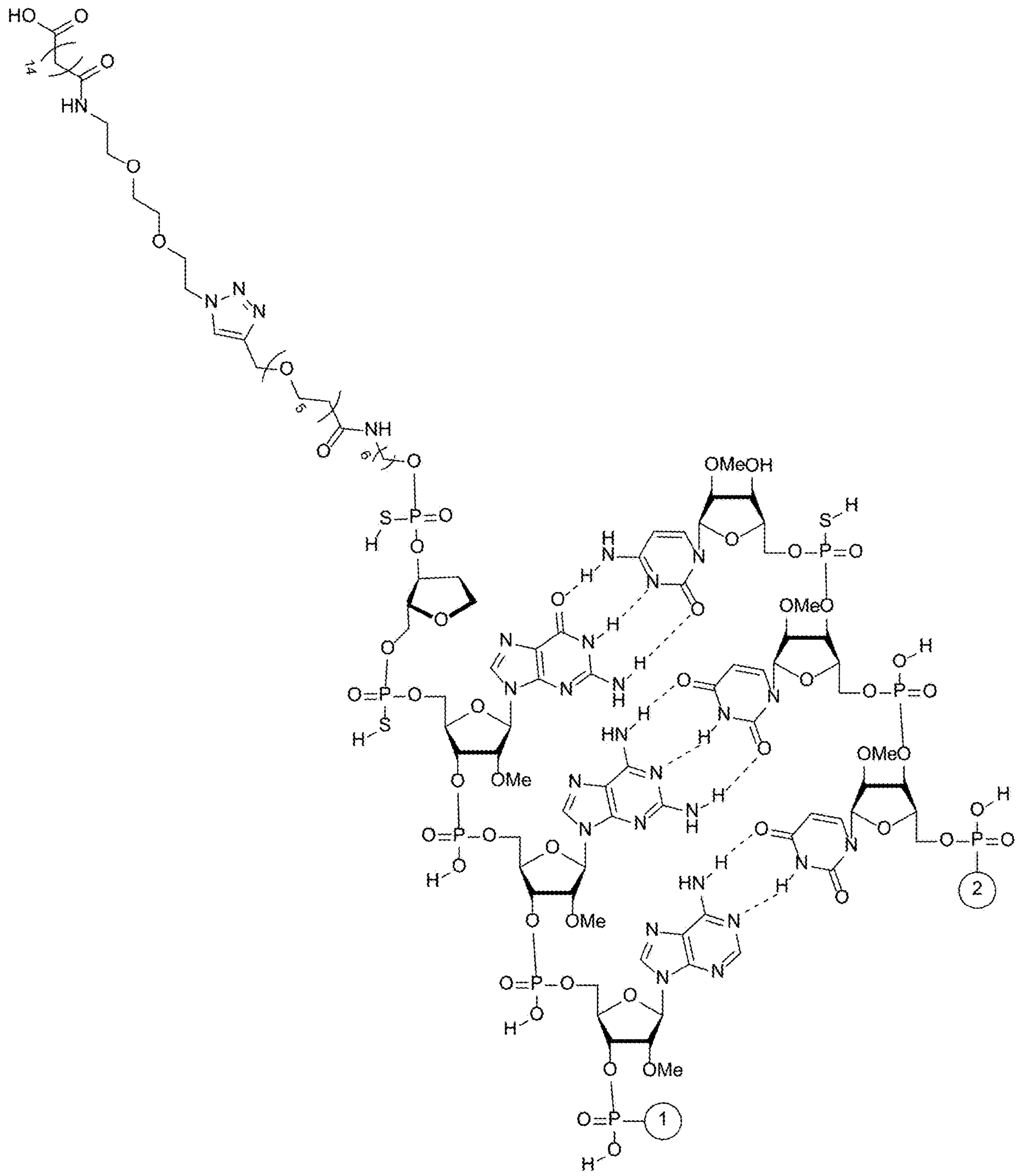
FIGS. 7A-7D show a chemical structure representation of ALK7 RNAi agent AC006661 (SEQ ID NOs: 328/533), shown with PK/PD modulators linked to the 5' and 3' ends of the sense strand, shown as a free acid.
Figure 7B:
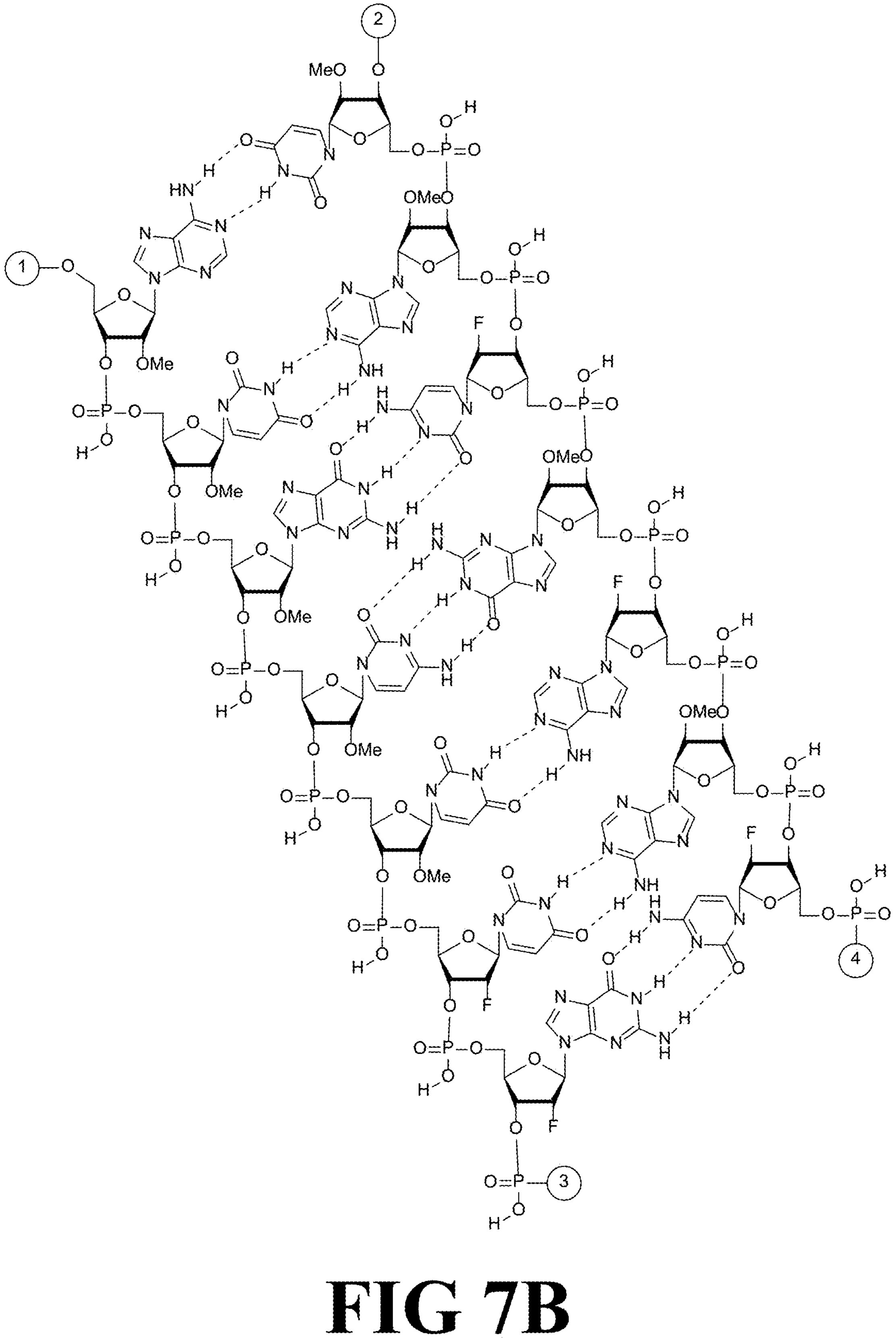
Figure 7C:
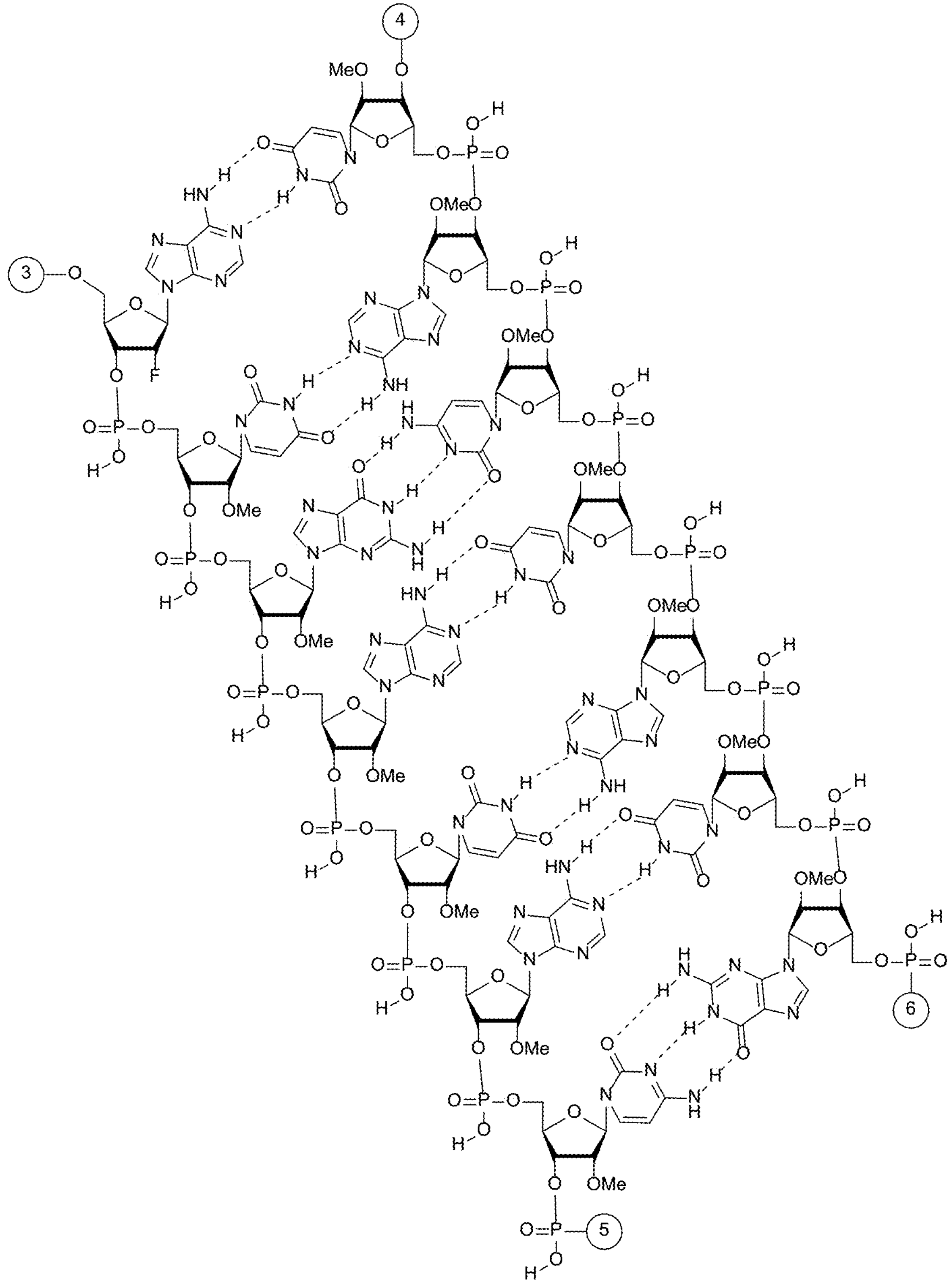
Figure 7D:
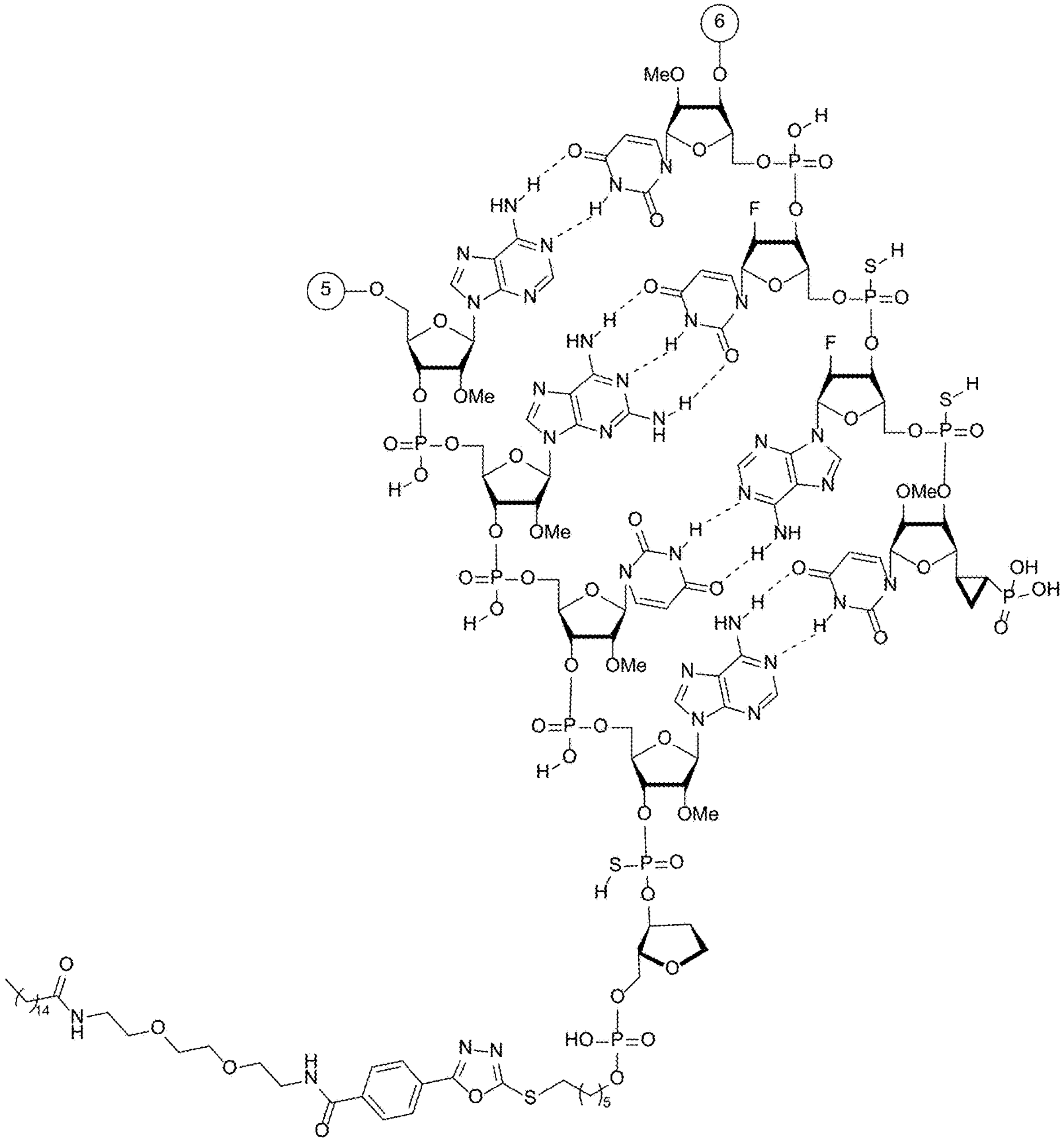
Figure 8A:
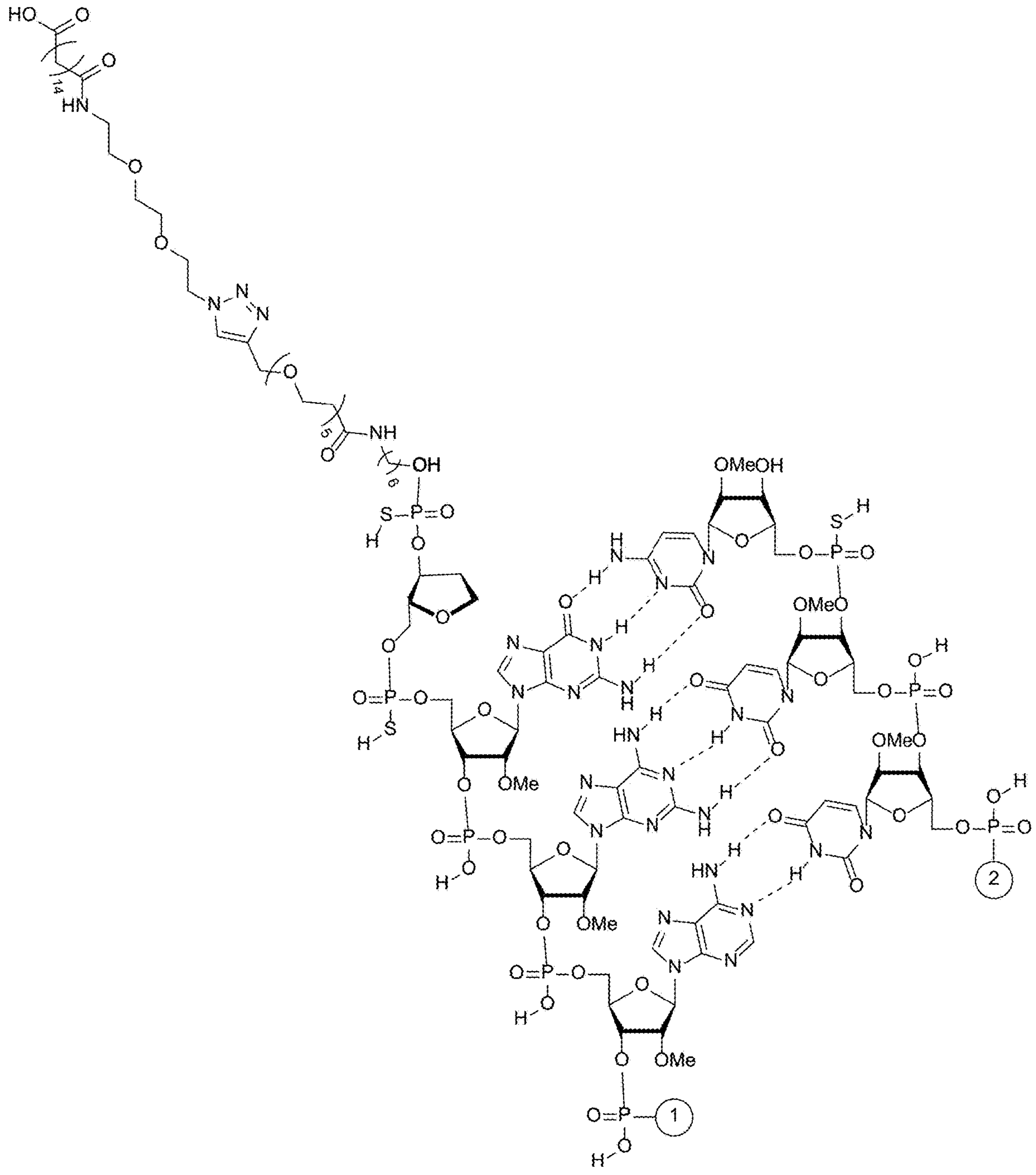
FIGS. 8A-8D show a chemical structure representation of ALK7 RNAi agent AC006663 (SEQ ID NOs: 330/533), shown with PK/PD modulators linked to the 5' and 3' ends of the sense strand, shown as a free acid.
Figure 8B:
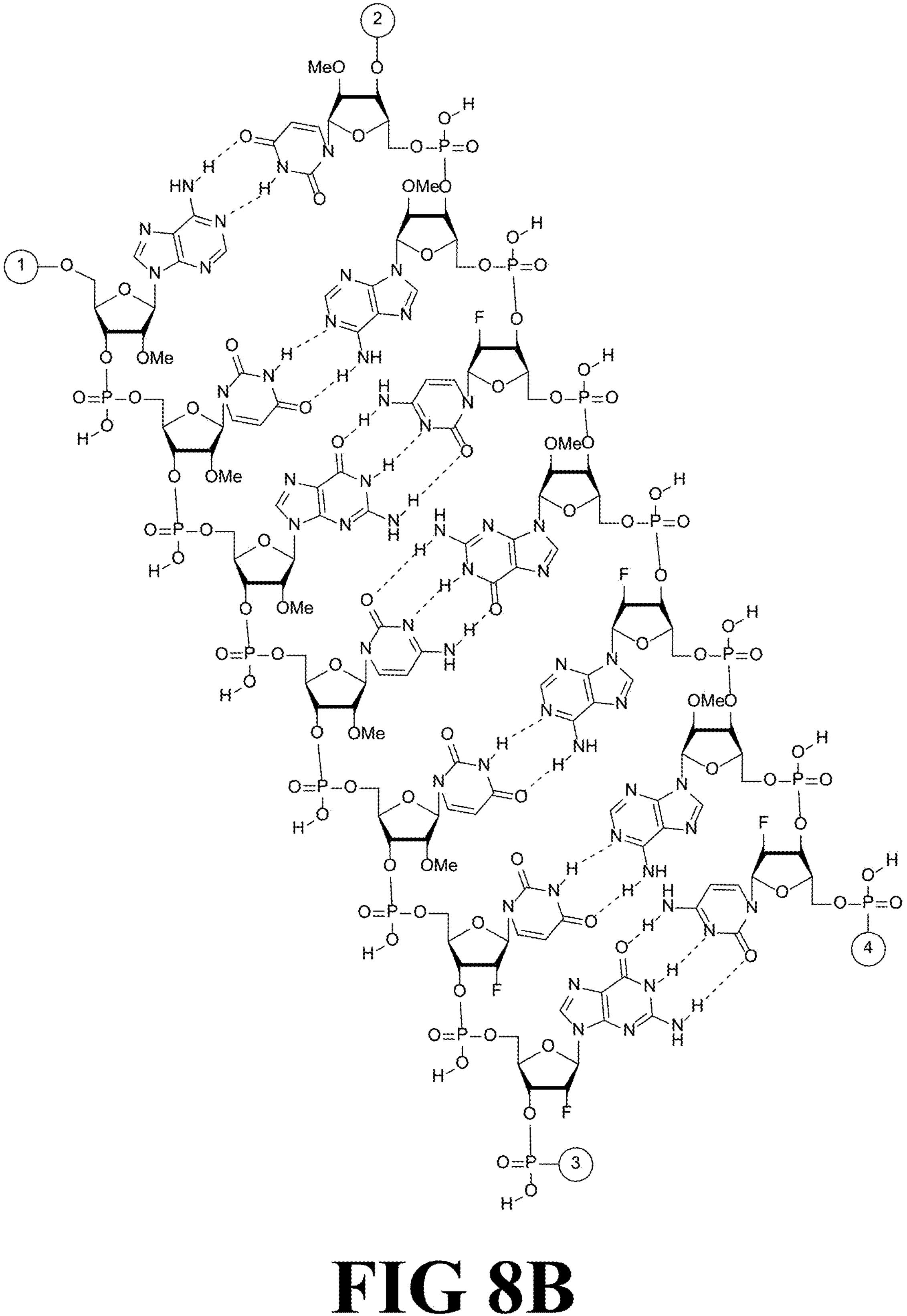
Figure 8C:
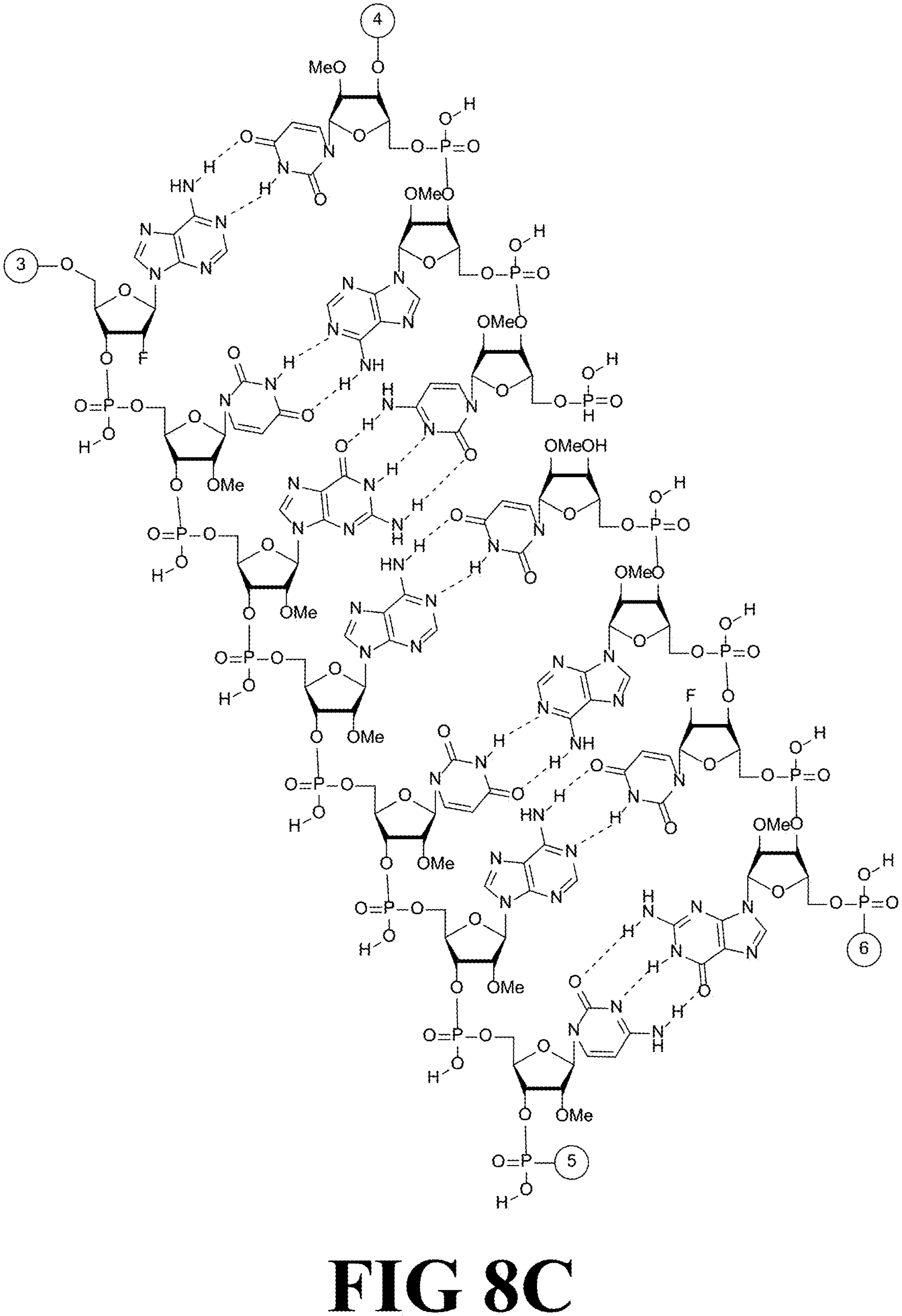
Figure 8D:
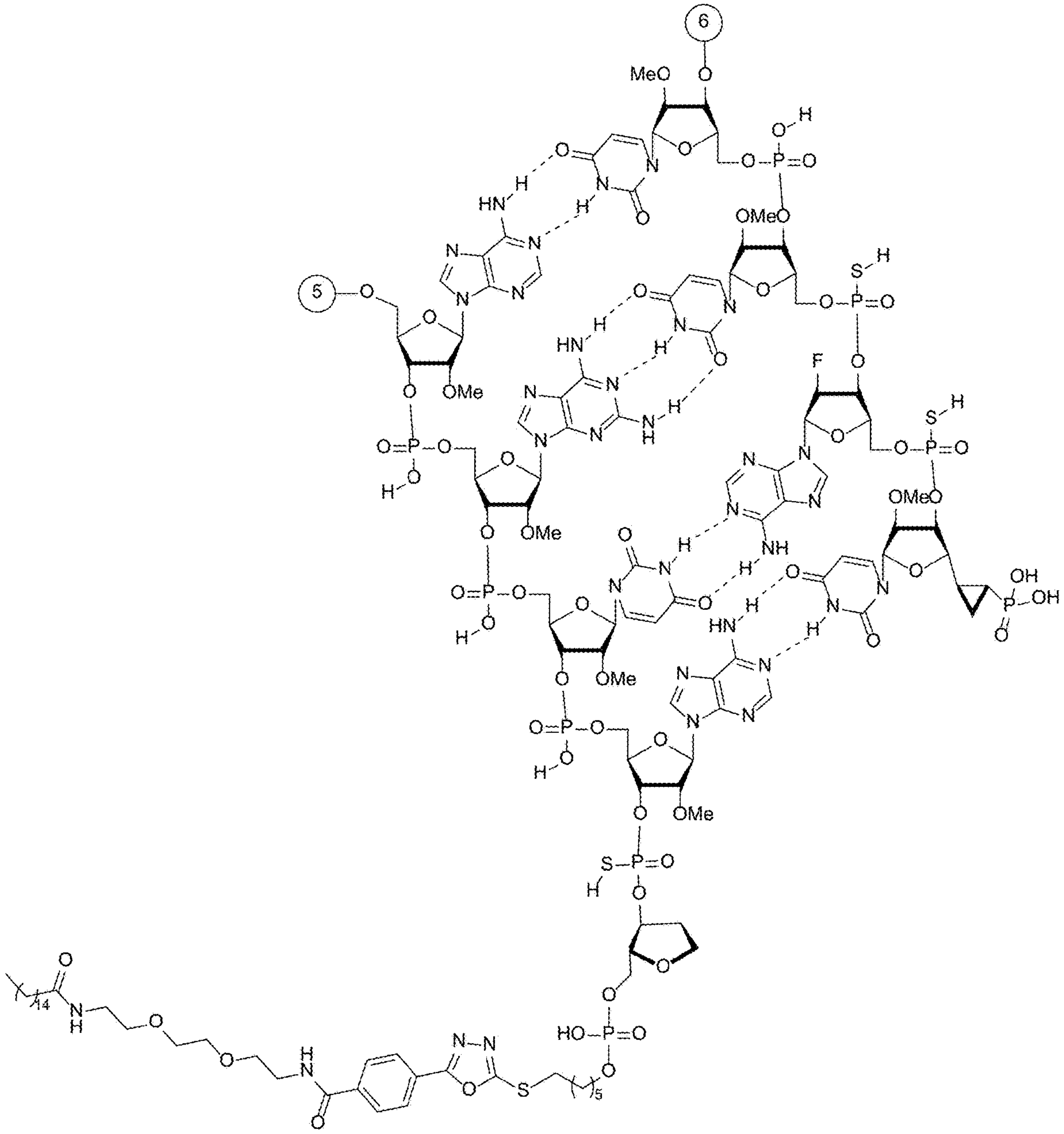
Figure 9A:
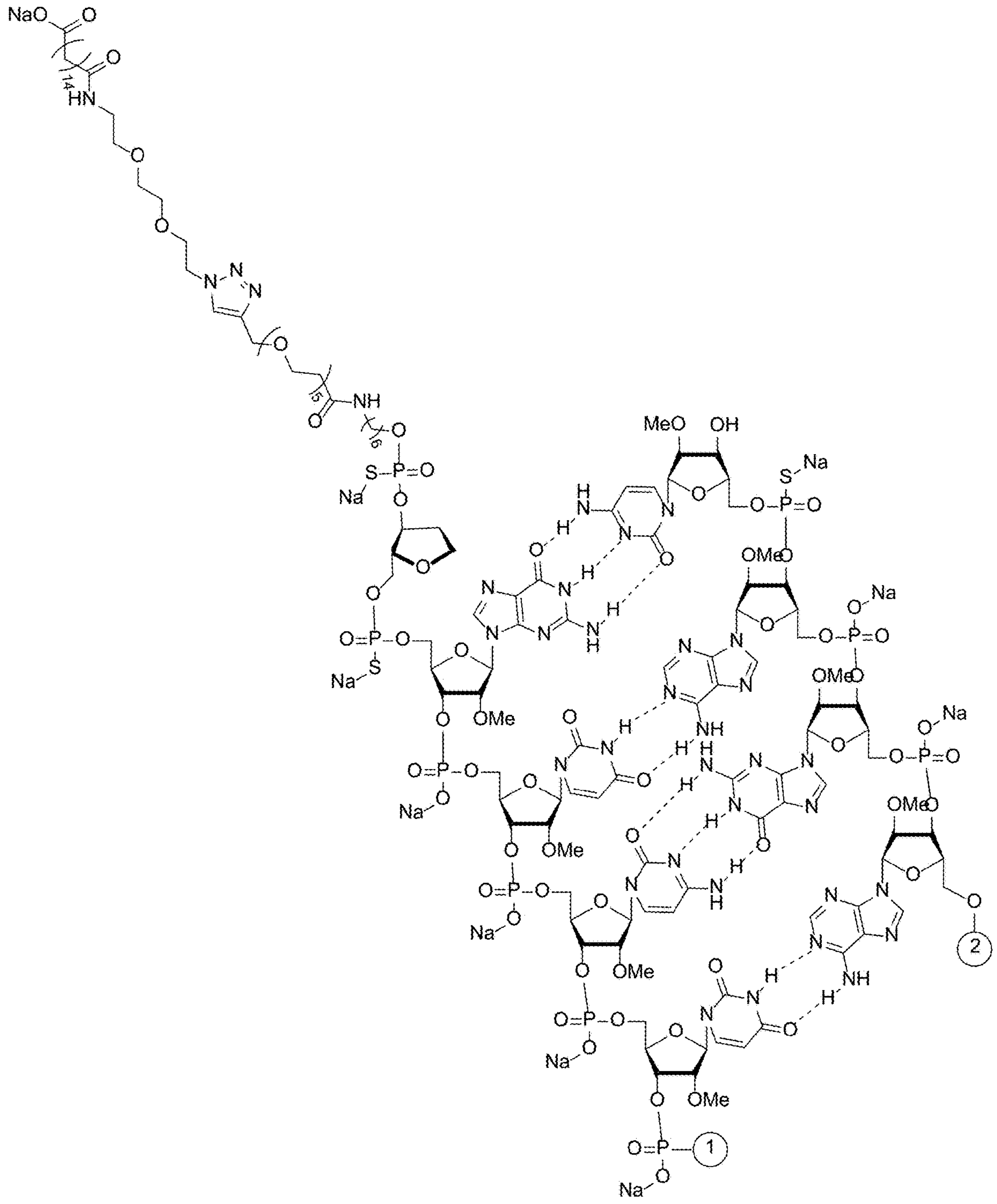
FIGS. 9A-9D show a chemical structure representation of ALK7 RNAi agent AC006188 (SEQ ID NOs: 269/535), shown with PK/PD modulators linked to the 5' and 3' ends of the sense strand, shown as a sodium salt.
Figure 9B:
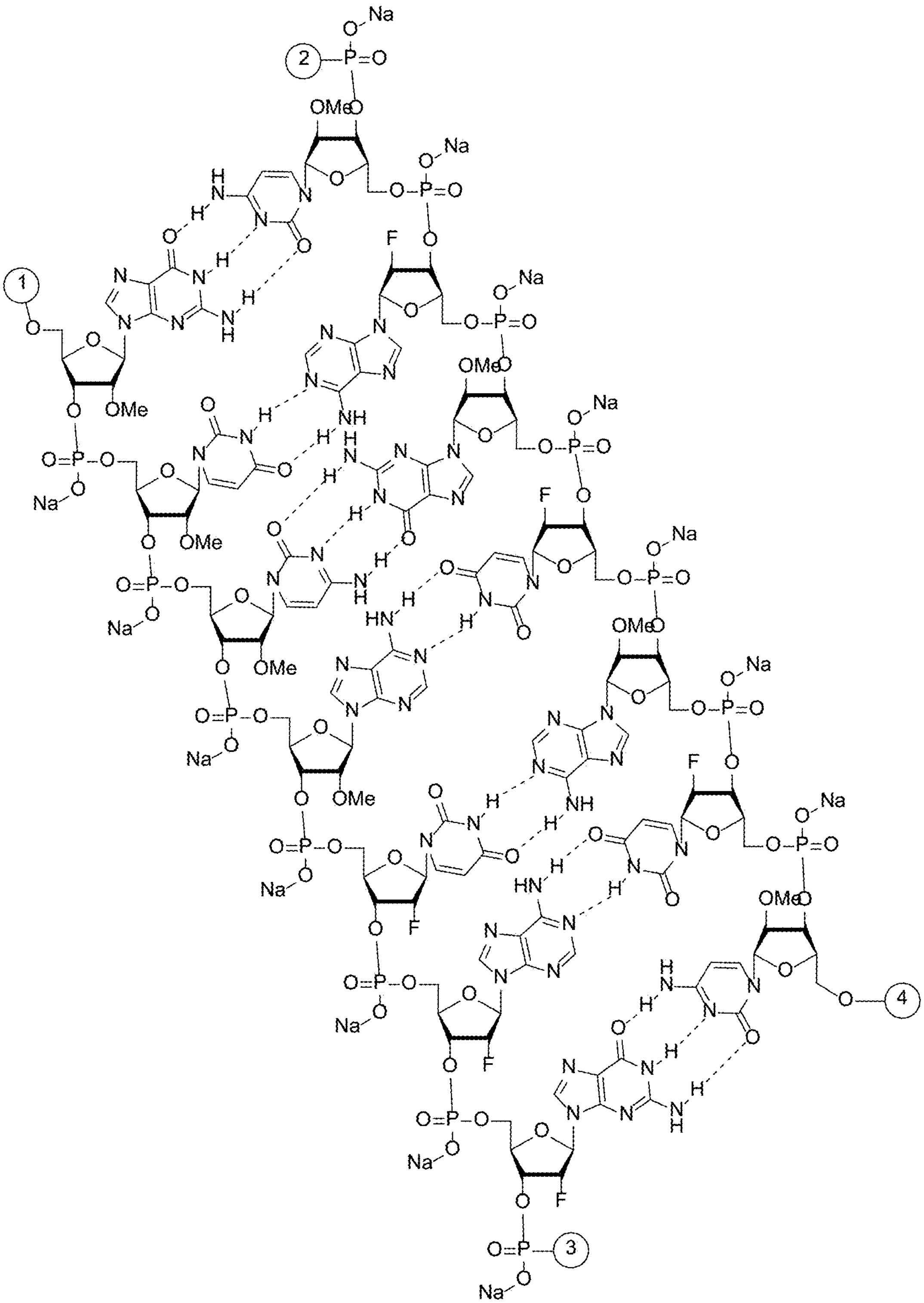
Figure 9C:
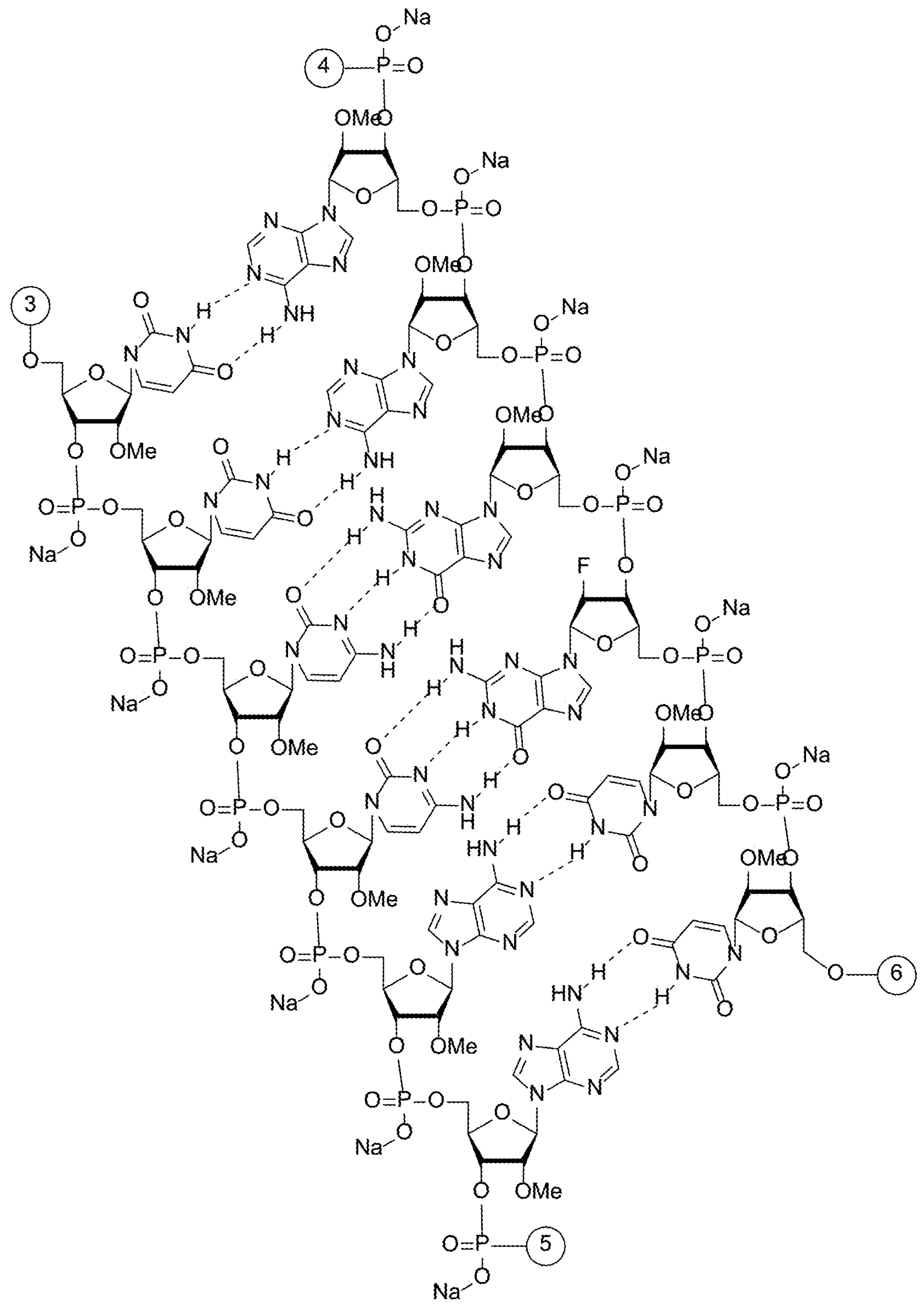
Figure 9D:
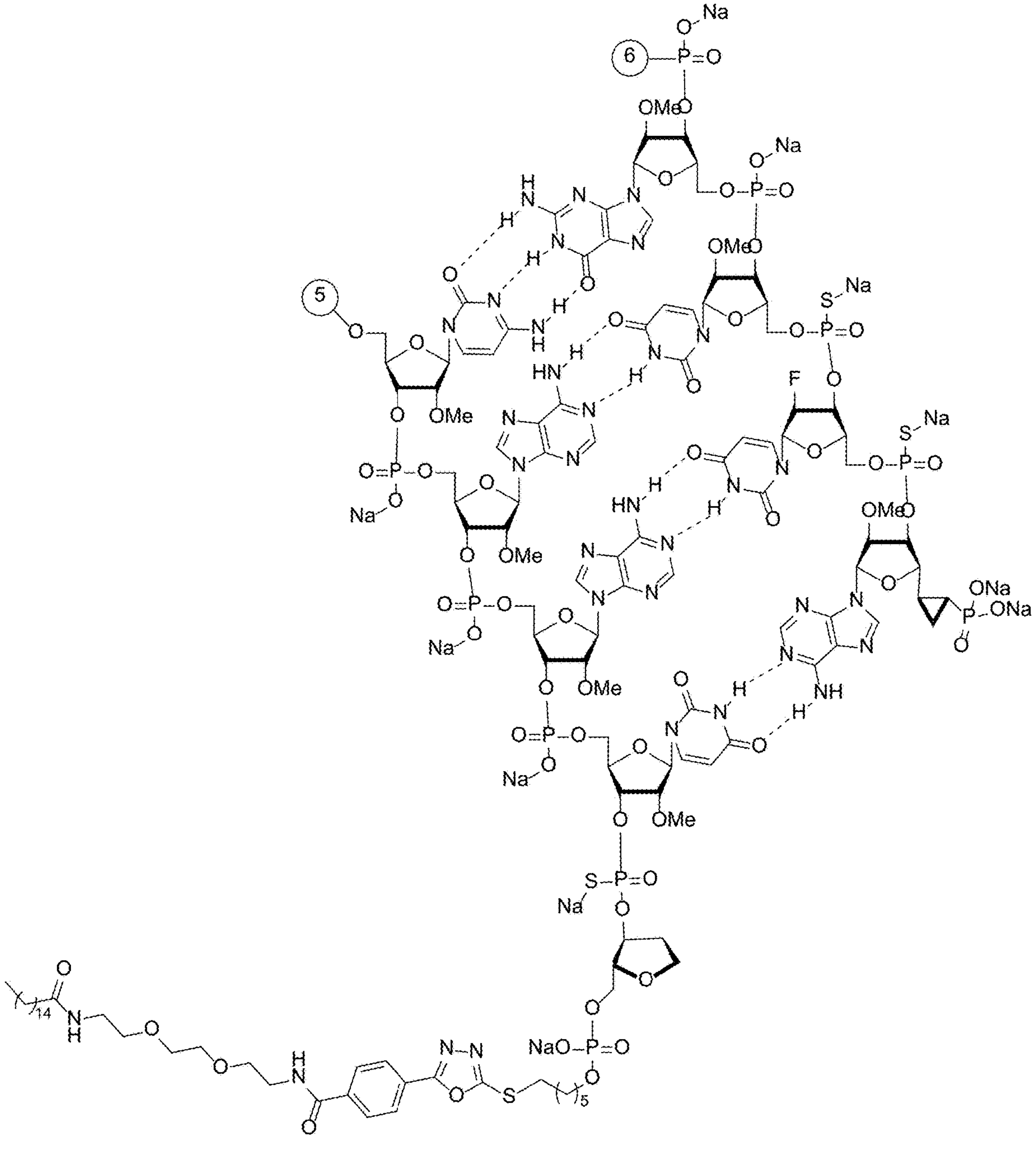
Figure 10A:
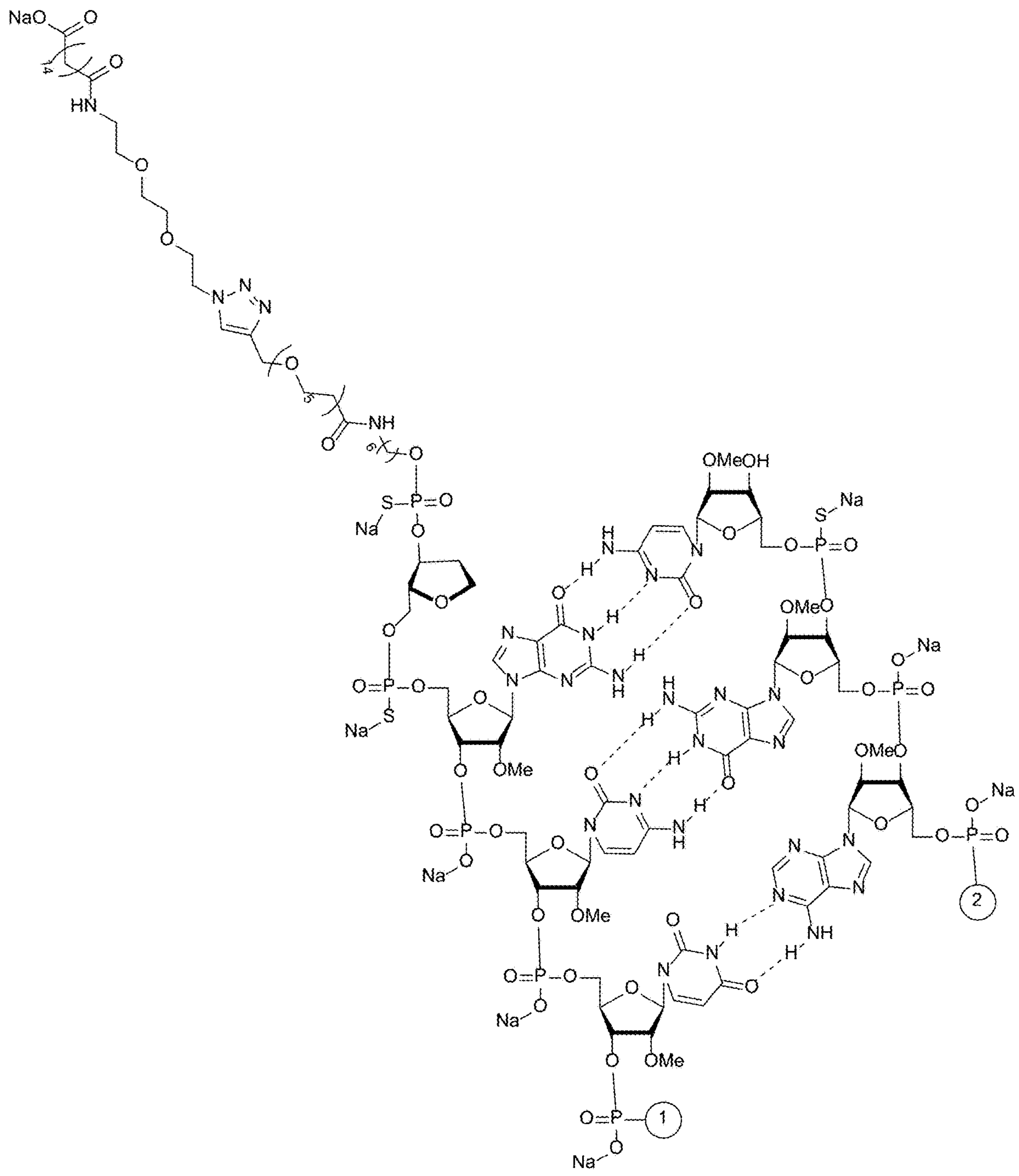
FIGS. 10A-10D show a chemical structure representation of ALK7 RNAi agent AC006189 (SEQ ID NOs: 270/536), shown with PK/PD modulators linked to the 5' and 3' ends of the sense strand, shown as a sodium salt.
Figure 10B:
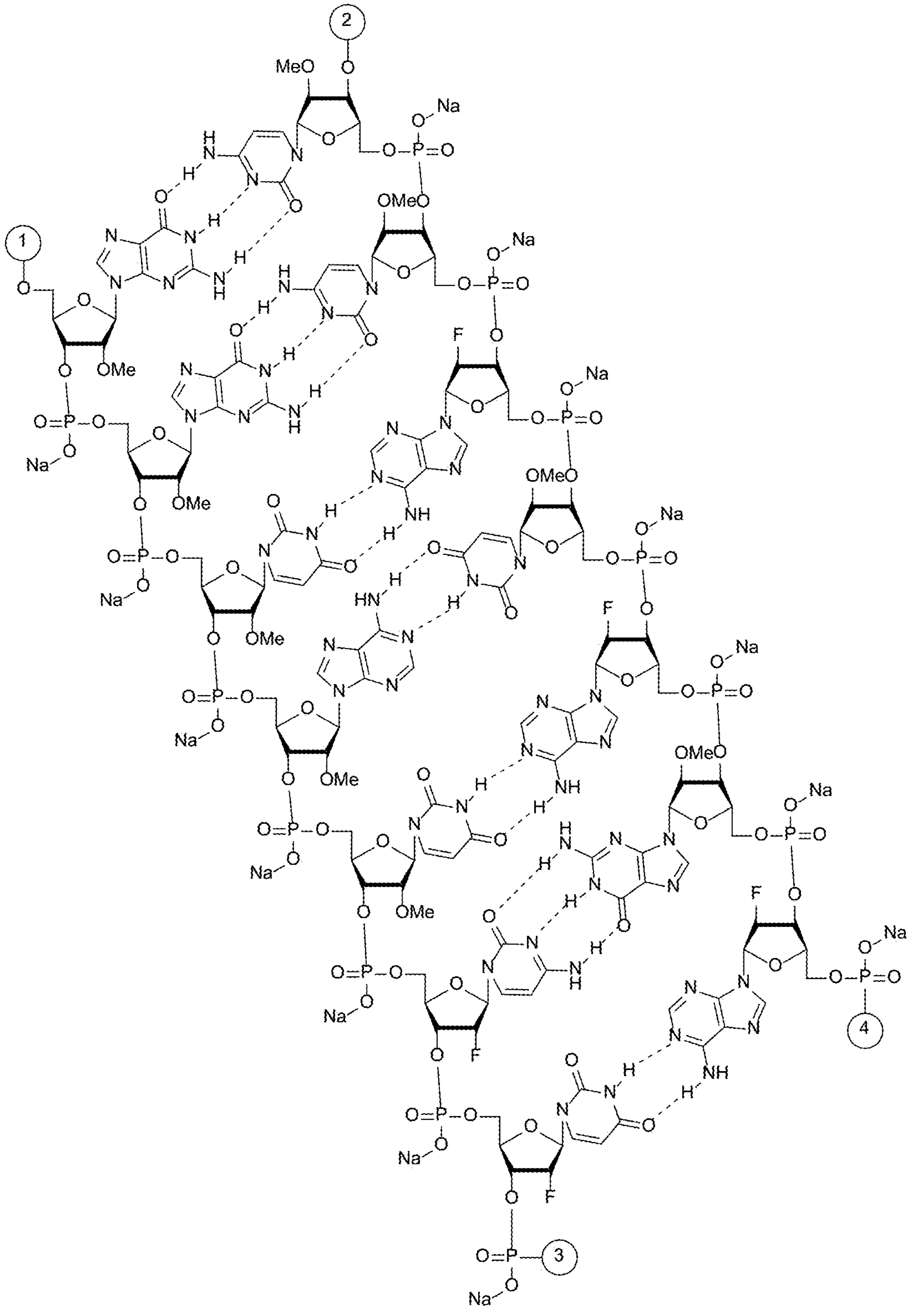
Figure 10C:
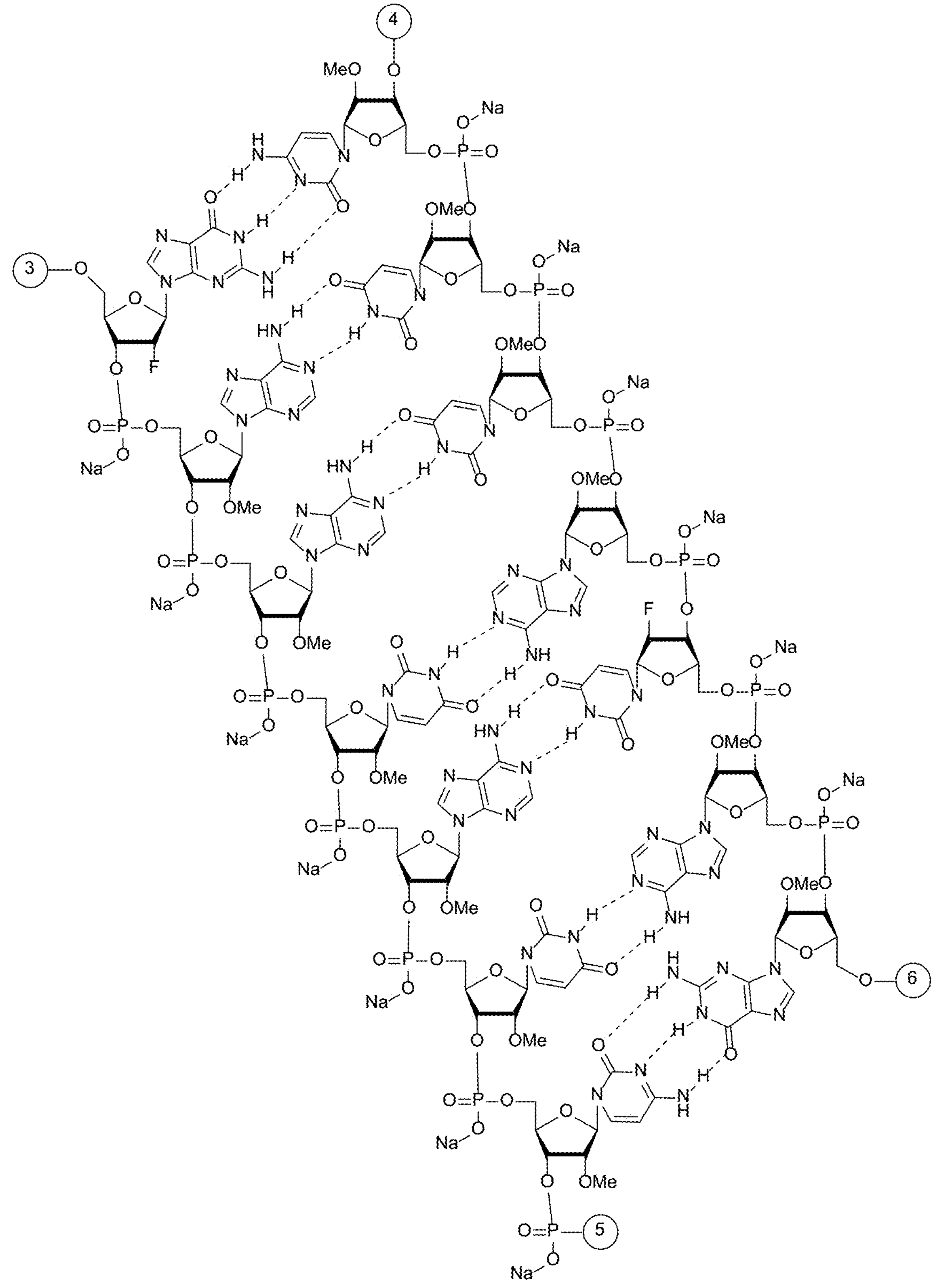
Figure 10D:
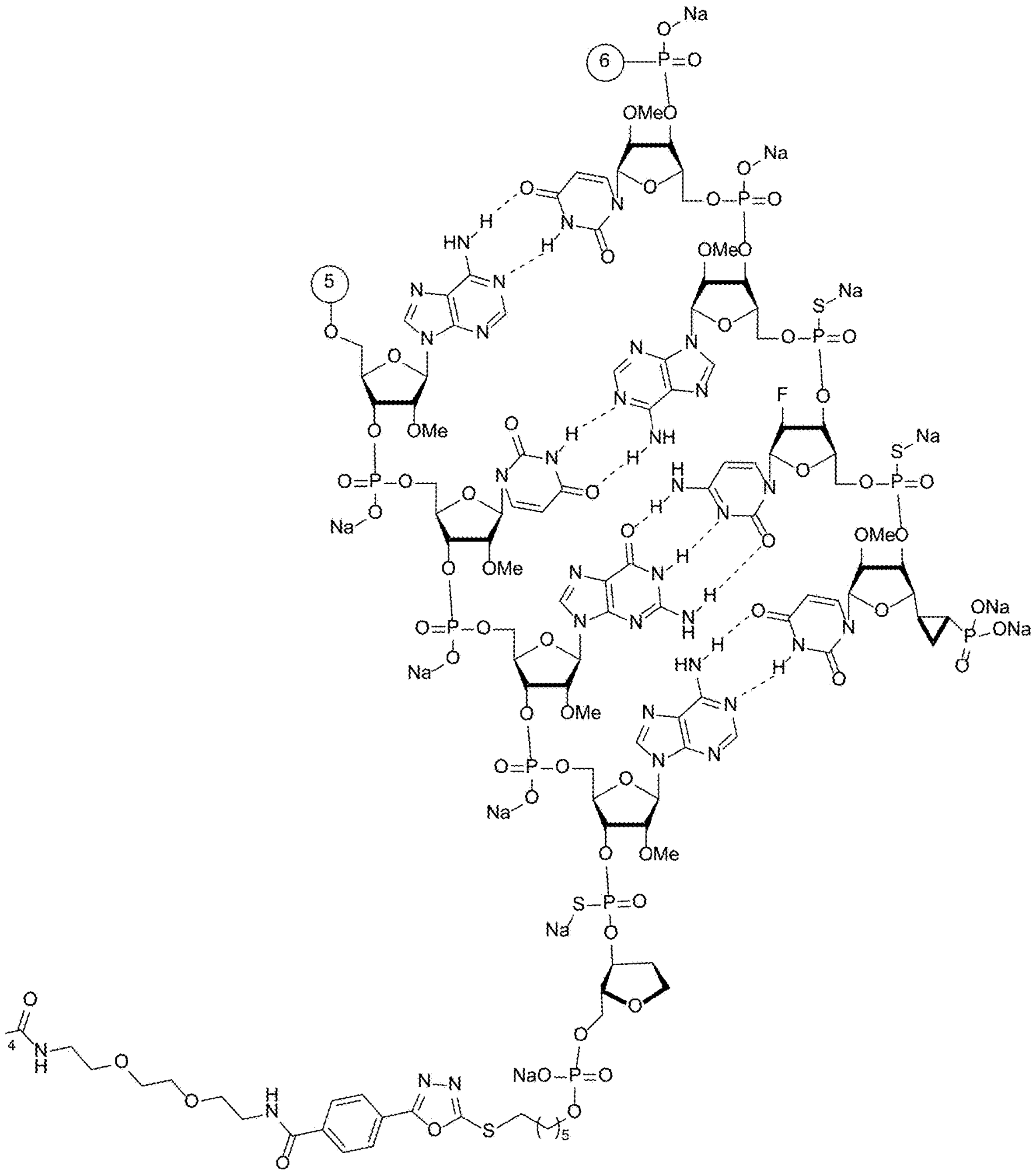
Figure 11A:
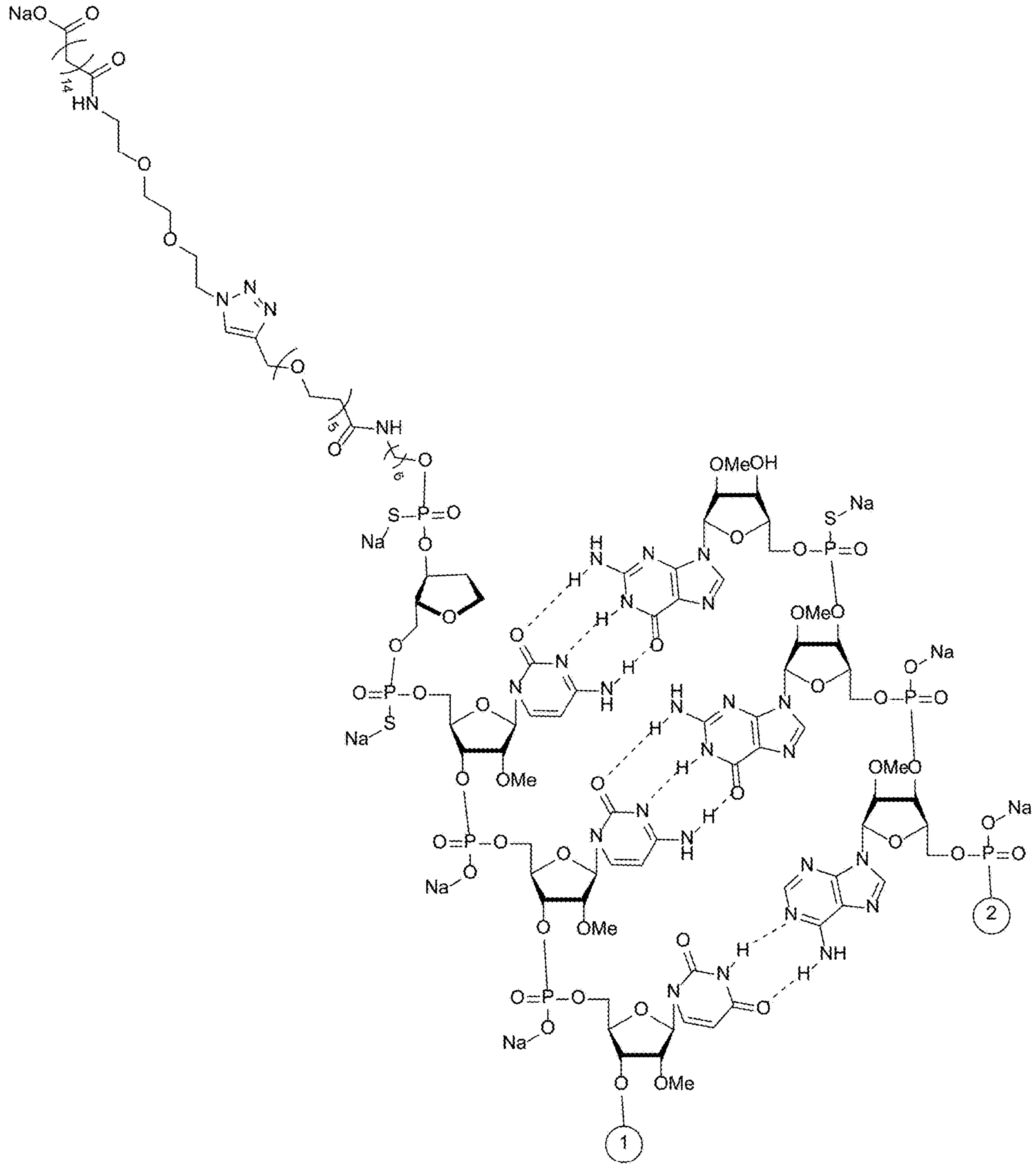
FIGS. 11A-11D show a chemical structure representation of ALK7 RNAi agent AC006648 (SEQ ID NOs: 320/534), shown with PK/PD modulators linked to the 5' and 3' ends of the sense strand, shown as a sodium salt.
Figure 11B:
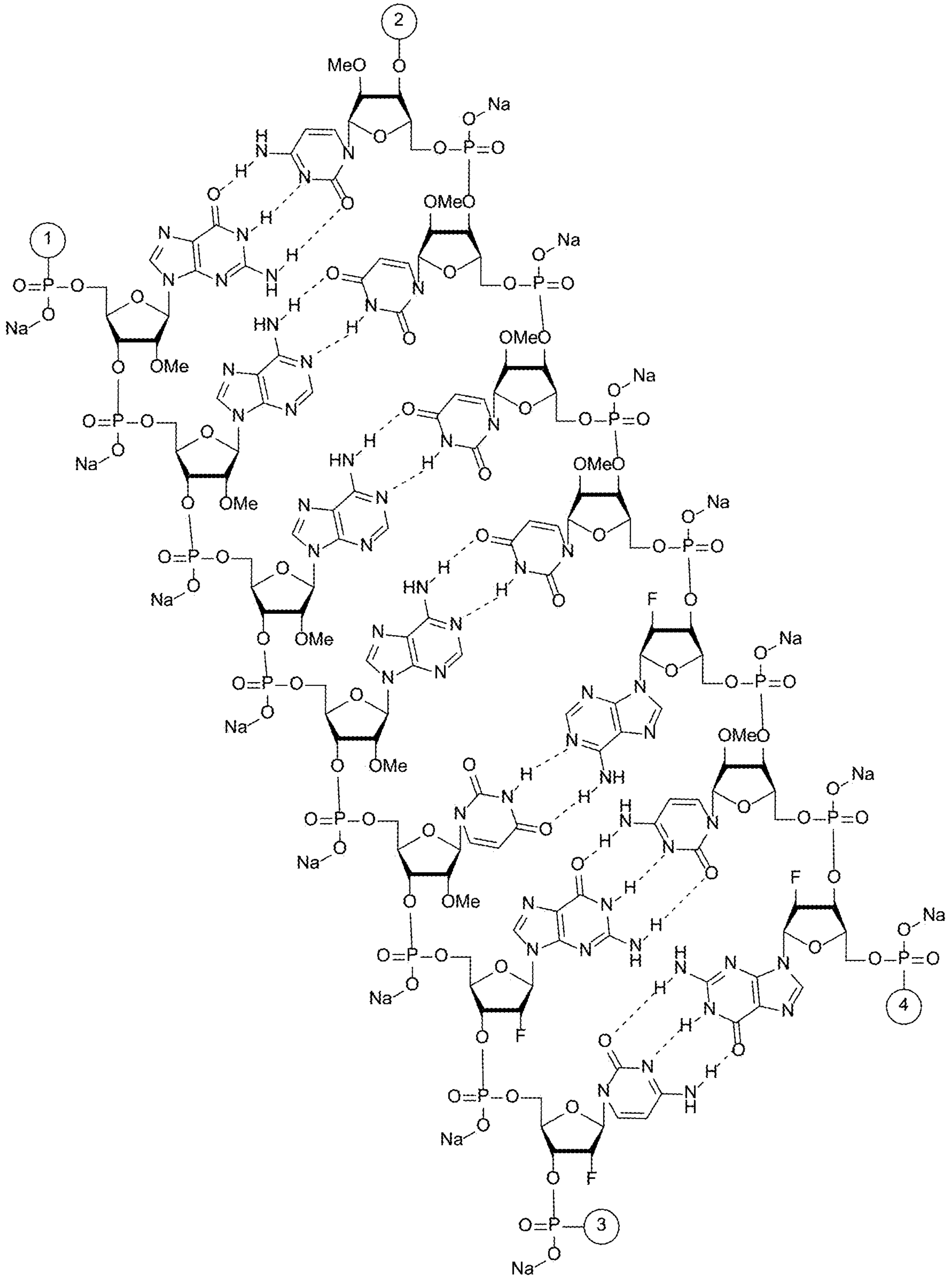
Figure 11C:
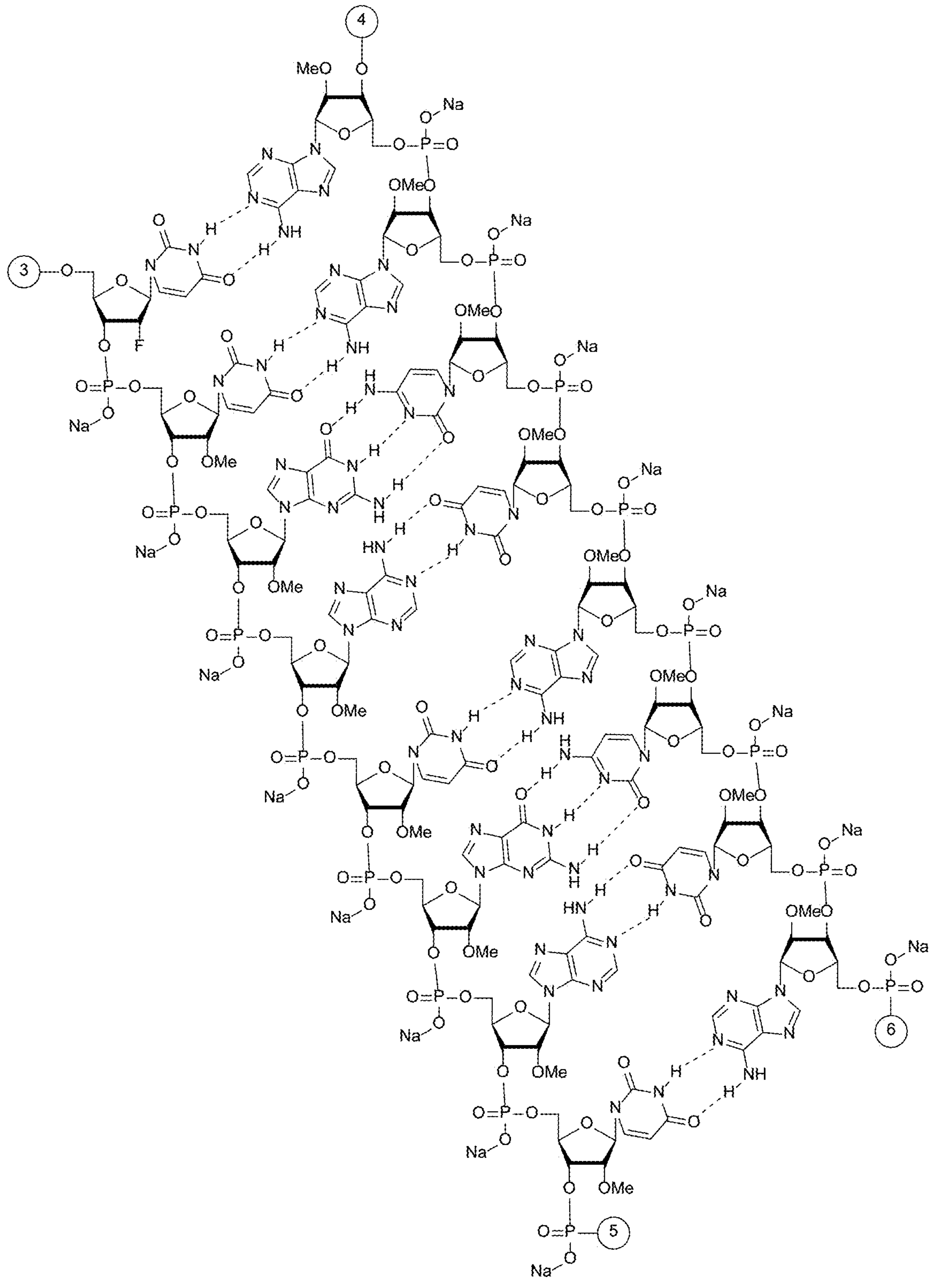
Figure 11D:
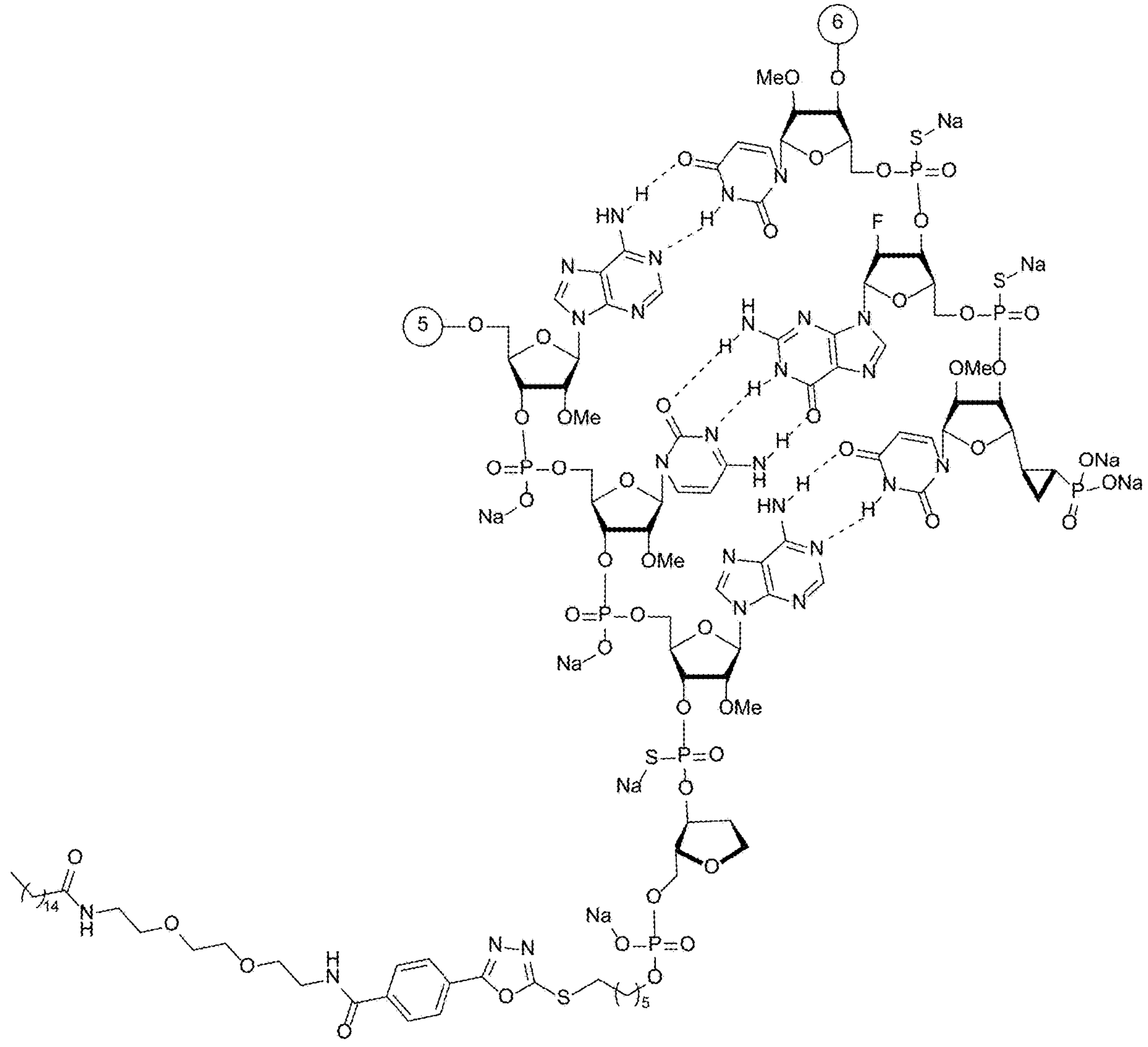
Figure 12A:
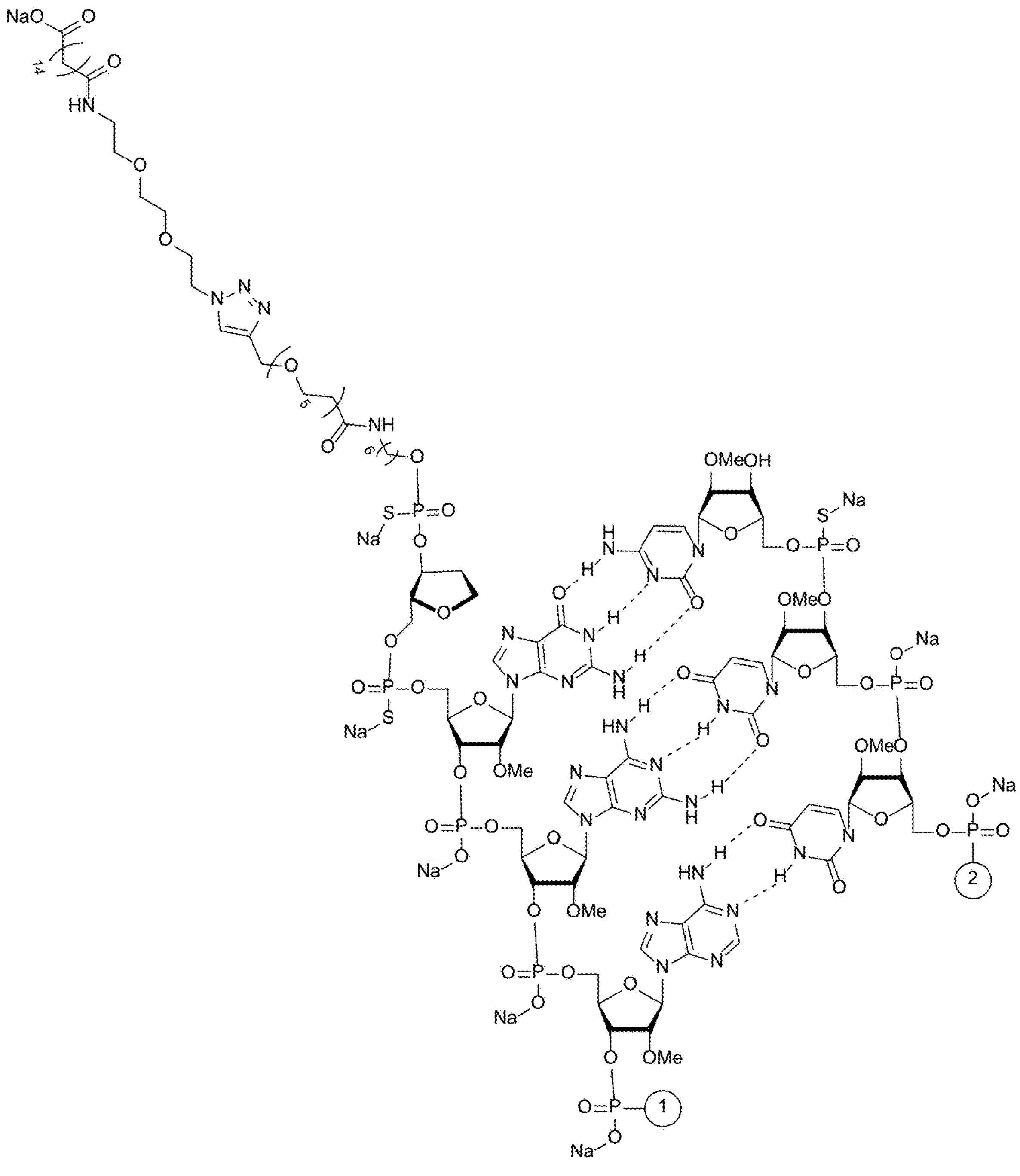
FIGS. 12A-12D show a chemical structure representation of ALK7 RNAi agent AC006661 (SEQ ID NOs: 328/533), shown with PK/PD modulators linked to the 5' and 3' ends of the sense strand, shown as a sodium salt.
Figure 12B:
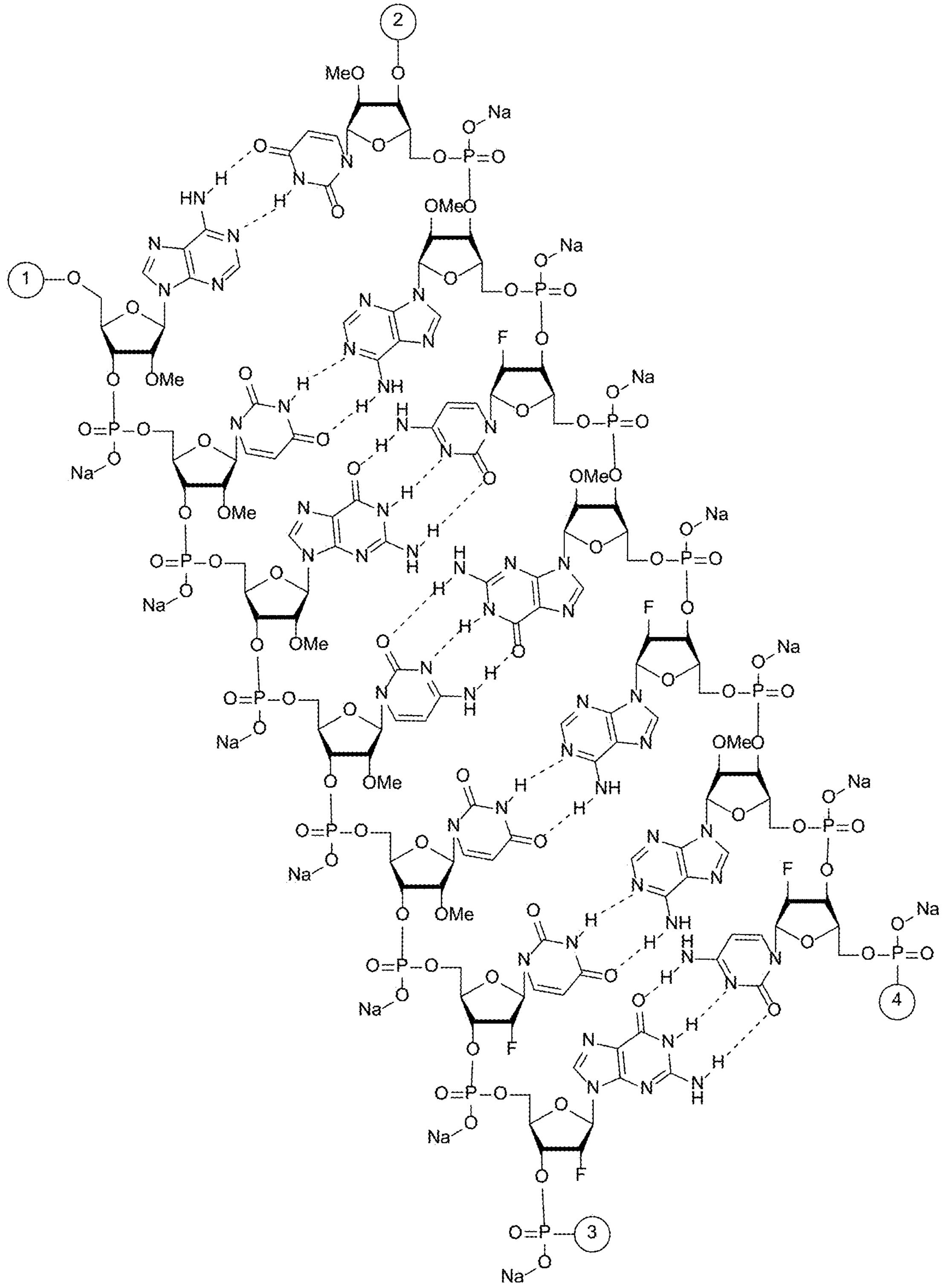
Figure 12C:
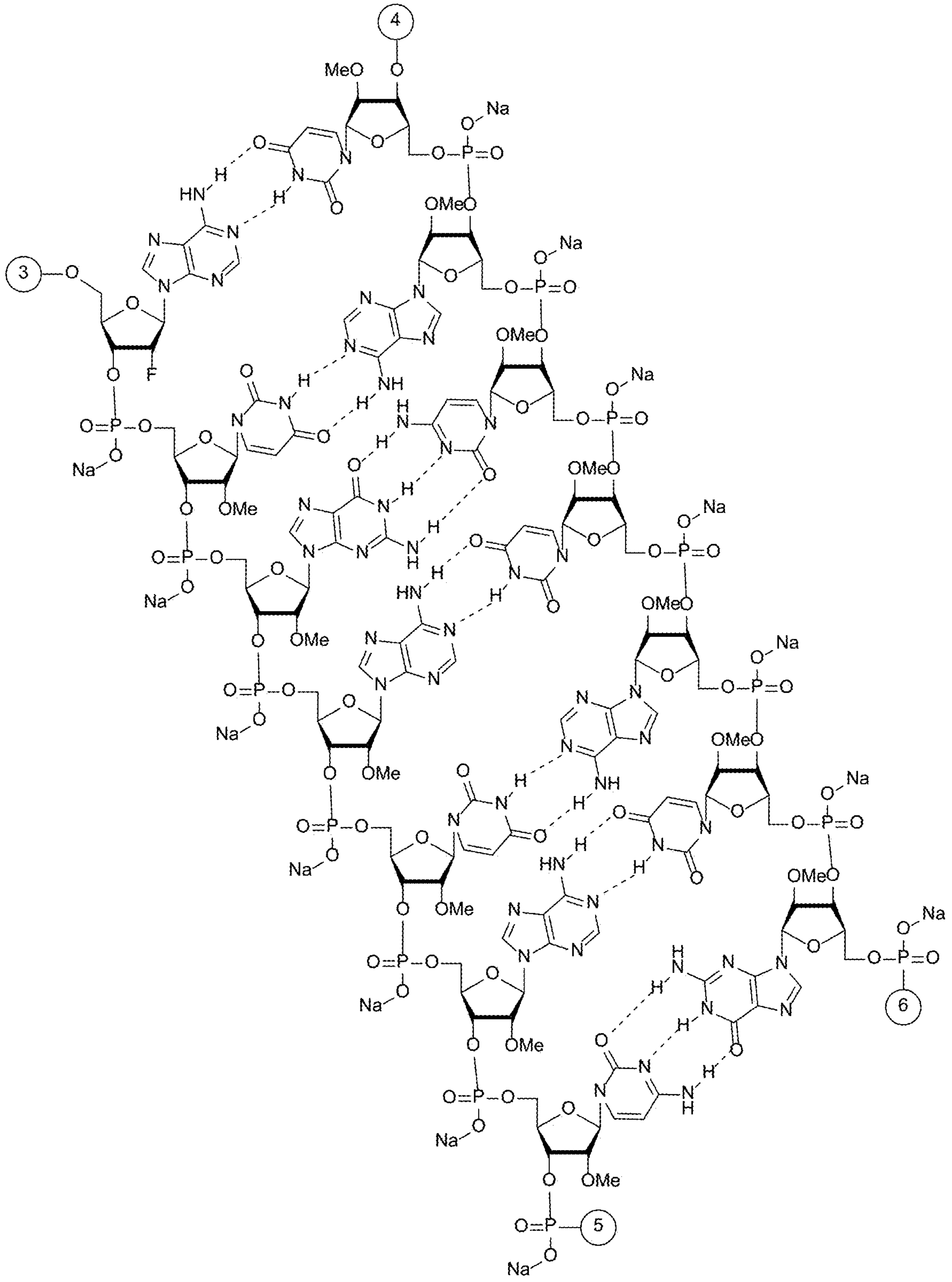
Figure 12D:
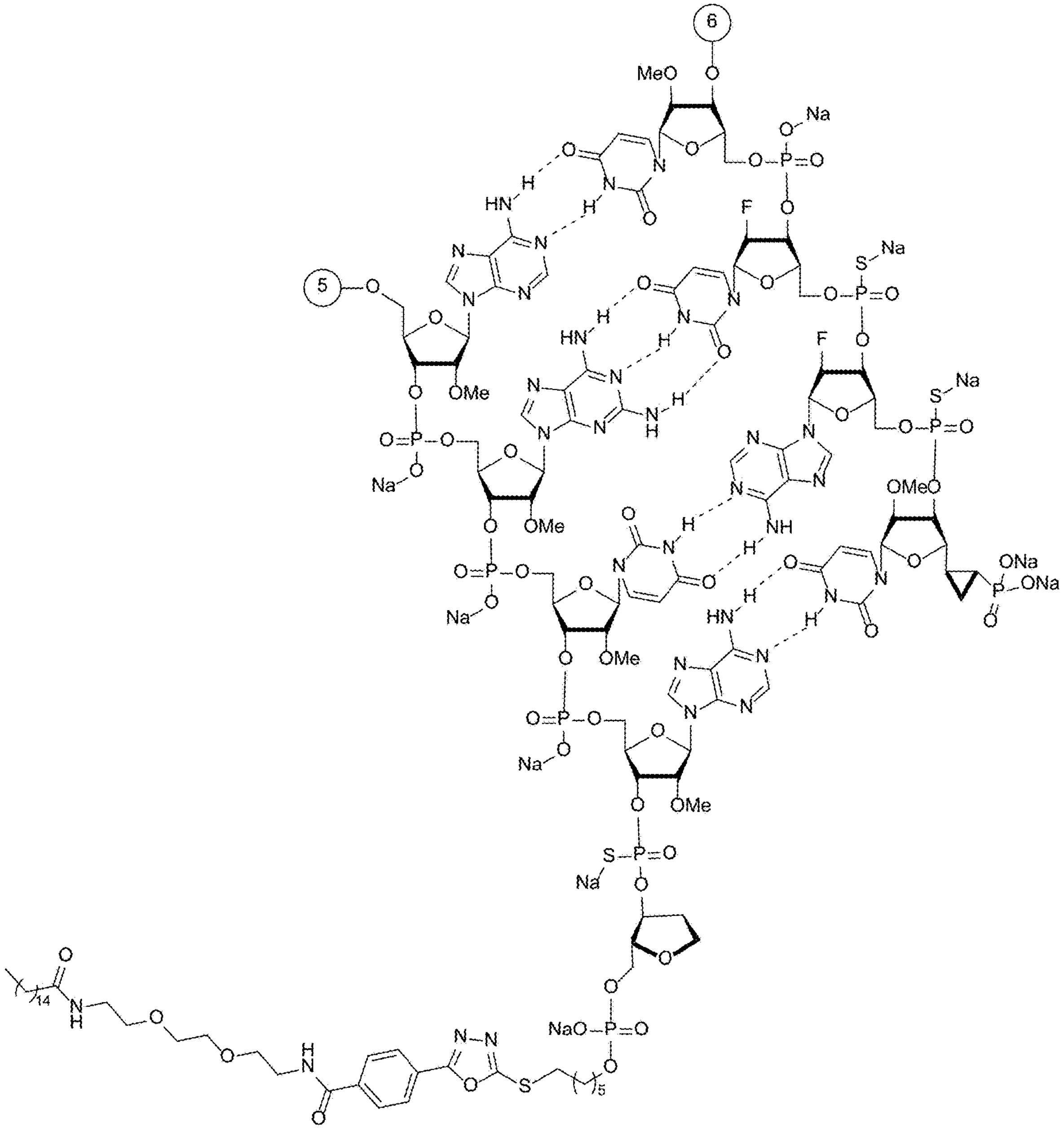
Figure 13A:
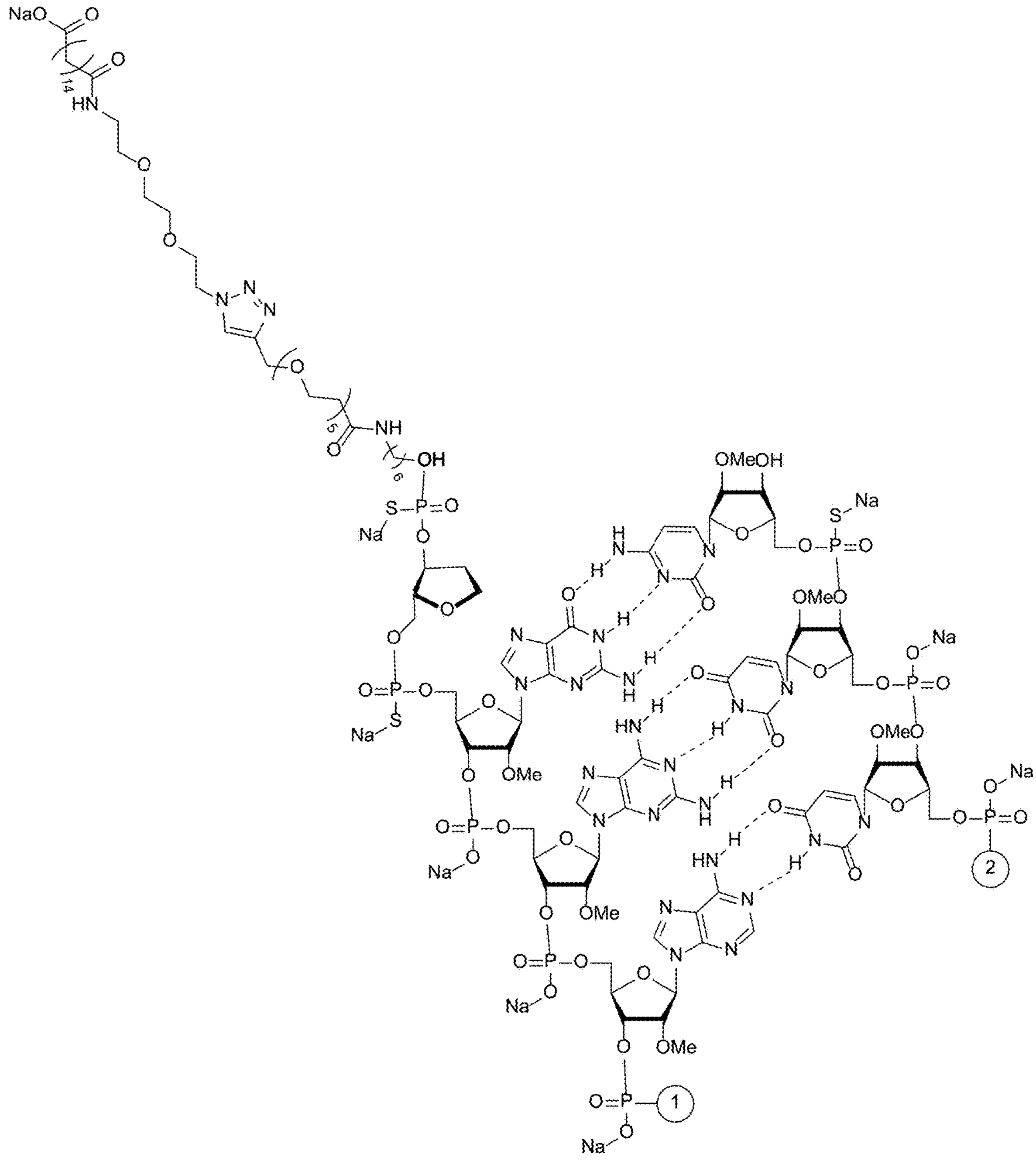
FIGS. 13A-13D show a chemical structure representation of ALK7 RNAi agent AC006663 (SEQ ID NOs: 330/533), shown with PK/PD modulators linked to the 5' and 3' ends of the sense strand, shown as a sodium salt.
Figure 13B:
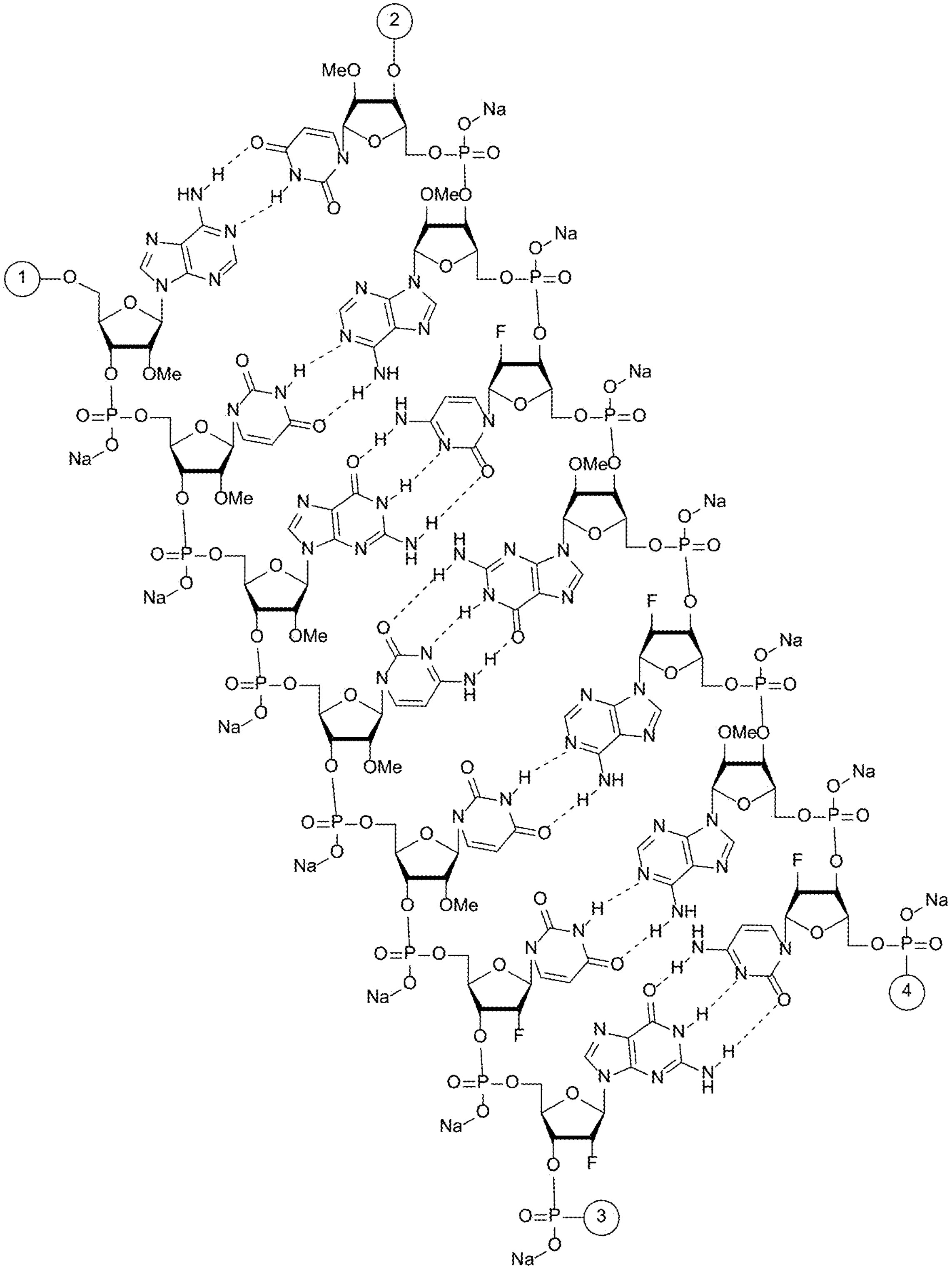
Figure 13C:
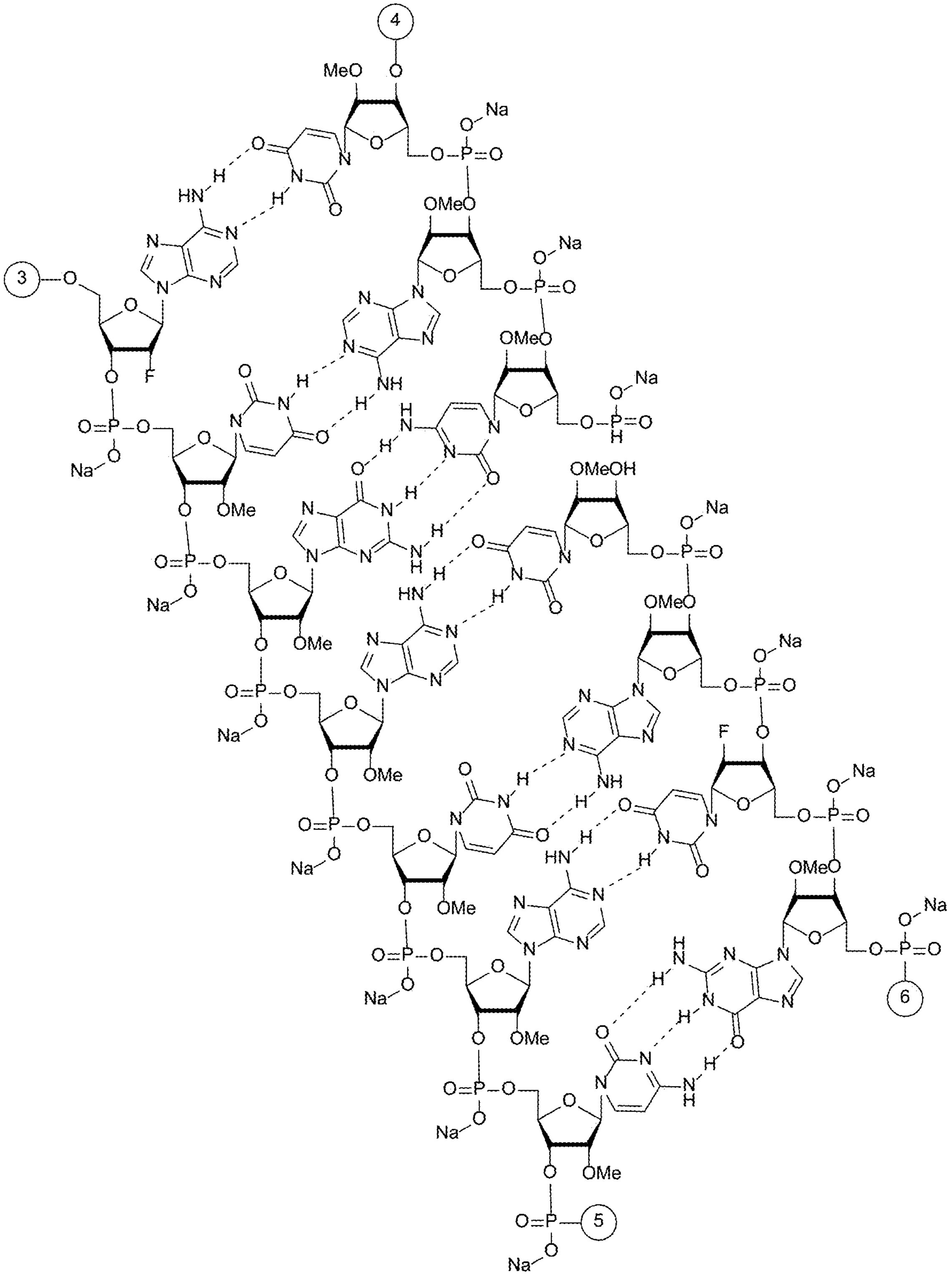
Figure 13D:
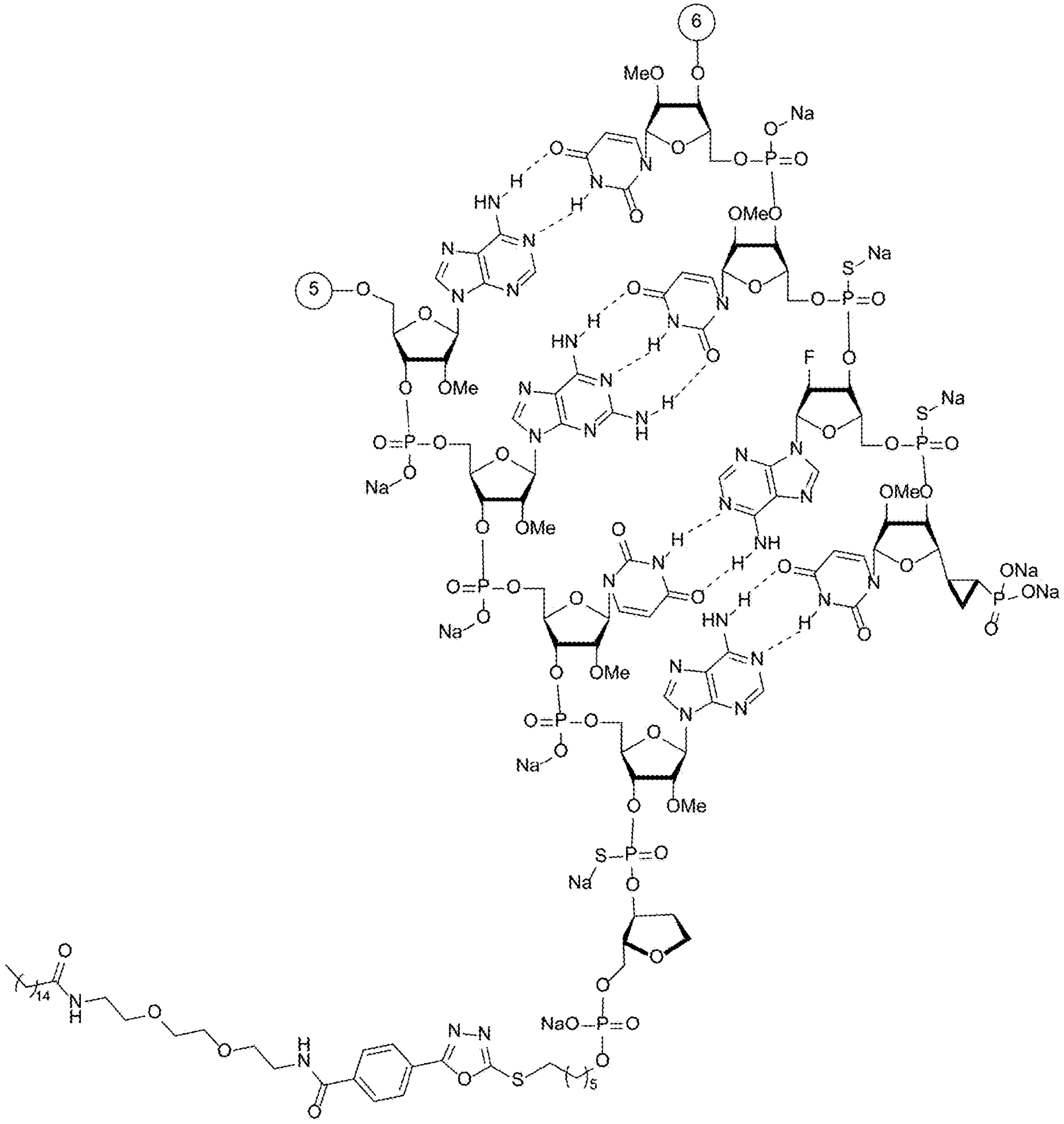

Proposed Study Design: A Phase 1/2a dose-escalating study to evaluate the safety, tolerability, PK, and PD of single and multiple doses of an ALK7 RNAi agent in adult volunteers with obesity (in Part 1) and the safety, tolerability, and PD of repeat doses of an ALK7 RNAi agent in adult volunteers with obesity with and without type 2 diabetes mellitus receiving tirzepatide (in Part 2). The duration of study participation will be approximately 24-32 weeks, from the beginning of the 56-day Screening period to the end of study (Day 113 or 169 for Part 1, and Day 169 for Part 2). The Study Schema for the proposed study are set forth in FIG. 3 (Part 1) and FIG. 4 (Part 2).

Summary of Proposed Part 1

Proposed Part 1A of the study will evaluate single ascending doses (SAD) of ALK7 RNAi agent in volunteers with obesity in Cohorts 1a, 2a, 3a, and 4a, to enroll 6 subjects in each cohort to be randomized with 4 subjects administered the ALK7 RNAi agent and 2 subjects administered placebo (PBO). Proposed Part 1B will evaluate multiple ascending doses (MAD) of ALK7 RNAi agent in volunteers with obesity in Cohorts 2b, 3b, and 4b, to also enroll 6 subjects in each cohort to be randomized with 4 subjects administered the ALK7 RNAi agent and 2 subjects administered placebo (PBO). Subcutaneous adipose tissue biopsies will be obtained at several timepoints for assessment of PD. Eligible subjects for Part 1 of the proposed study will include adult non-pregnant, non-lactating subjects, between 18-65 years old, with obesity (BMI 30-50 kg/m2), without evidence of Type 2 Diabetes at Screening (confirmed by laboratory assessment), stable weight at the time of Screening (no increase or decrease in weight >5% in the preceding 3 months), and at least one self-reported unsuccessful attempt at weight loss with lifestyle modification.

Summary of Proposed Part 2

Proposed Part 2 of the study will evaluate repeat doses of ALK7 RNAi agent in subjects with obesity with and without Type 2 Diabetes Mellitus also receiving tirzepatide. Each of Cohorts 5A and 5B of proposed Part 2 of the study will enroll and randomize 12 subjects with obesity without Type 2 Diabetes Mellitus, with 8 subjects administered the ALK7 RNAi agent and 4 subjects administered placebo (PBO). Cohort 5C will enroll and randomize 12 subjects with obesity with Type 2 Diabetes Mellitus, with 8 subjects administered the ALK7 RNAi agent and 4 subjects administered placebo (PBO). As shown in FIG. 4, eligible subjects enrolled in Cohort 5A, Cohort 5B, and Cohort 5C will be randomized (2:1) to combined therapy with tirzepatide and an ALK7 RNAi agent (intervention arm) or tirzepatide monotherapy (control/PBO arm). Tirzepatide in Cohort 5A and Cohort 5C will be initiated on Day 1 at a dose of 2.5 mg SC weekly for four weeks, then escalated to a dose of 5 mg SC weekly. Tirzepatide in Cohort 5B will be initiated in all subjects on Day 1 at a dose of 2.5 mg SC weekly for four weeks; subjects assigned to the control arm will then have dose escalation to 5 mg SC weekly, while subjects assigned to the intervention group will continue tirzepatide at 2.5 mg SC weekly. ALK7 RNAi agent (or matched volume of PBO) will be administered as subcutaneous injections on Day 1 and Day 29, at a dose level to be determined based on safety and pharmacodynamic data from Part 1 of the study. Subcutaneous adipose tissue biopsies will be obtained at several timepoints for assessment of PD. Subjects in Cohorts 5A, 5B, and 5C will be followed until Day 169 (end of study).

Eligible subjects for Part 2 of the study, subject to certain additional exclusion criteria, will include adult non-pregnant, non-lactating subjects, between 18-65 years old, with obesity (BMI 30-50 kg/m2), either with [Cohort 5C] or without [Cohorts 5A, 5B] Type 2 Diabetes Miletus (T2DM), stable weight at the time of screening (no increase or decrease in weight >5% in the preceding 3 months), and at least one self-reported unsuccessful attempt at weight loss with lifestyle modification.

Example 23. In Vivo Administration of ALK7 RNAi Agents in ALK7-Gluc-AAV Mice

The ALK7-GLuc-AAV model as described in Example 6, above, was used. On Day −21, six (n=6) male C57bl/6 mice in each group were dosed with ~4×10^12 GC/kg ALK7-GLuc AAV8, via intravenous IV injection, at 250 μL per 25 g body weight injection volume. On Day 1, the mice were dosed with either saline or ALK7 RNAi agents formulated in saline (at 1.5 mg/kg), via subcutaneous (SQ) injection, at 250 μL per 25 g body weight injection volume. The dosing regimen was in accordance with Table 47 below.

TABLE 47

Dosing Groups of Example 23.

| Group ID | RNAi Agent | Dose | Dosing Regimen | # of Animals (n =) |
|---|---|---|---|---|
| 1 | Saline | N/A | Day 1 SQ Injection | n = 6 |
| 2 | AC005864 | 1.5 mg/kg | Day 1 SQ Injection | n = 6 |
| 3 | AC007199 | 1.5 mg/kg | Day 1 SQ Injection | n = 6 |
| 4 | AC007200 | 1.5 mg/kg | Day 1 SQ Injection | n = 6 |
| 5 | AC007201 | 1.5 mg/kg | Day 1 SQ Injection | n = 6 |
| 6 | AC004201 | 1.5 mg/kg | Day 1 SQ Injection | n = 6 |
| 7 | AC007202 | 1.5 mg/kg | Day 1 SQ Injection | n = 6 |
| 8 | AC007203 | 1.5 mg/kg | Day 1 SQ Injection | n = 6 |
| 9 | AC007204 | 1.5 mg/kg | Day 1 SQ Injection | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 48, with average GLuc reflecting the normalized average value of GLuc. Inhibition of ALK7 expression by an ALK7 RNAi agent results in concomitant inhibition of GLuc expression, which is measured.

TABLE 48

Average GLuc normalized to pre-treatment and saline control in ALK7-Gluc AAV mice of Example 23.

| Group ID | Day 1 Avg GLuc | Day 1 Std Dev | Day 8 Avg GLuc | Day 8 Std Dev | Day 15 Avg GLuc | Day 15 Std Dev |
|---|---|---|---|---|---|---|
| 1. Saline | 1.000 | 0.000 | 1.000 | 0.225 | 1.000 | 0.224 |
| 2. 1.5 mg/kg AC005864 | 1.000 | 0.000 | 0.311 | 0.041 | 0.243 | 0.054 |
| 3. 1.5 mg/kg AC007199 | 1.000 | 0.000 | 0.285 | 0.077 | 0.336 | 0.068 |
| 4. 1.5 mg/kg AC007200 | 1.000 | 0.000 | 0.238 | 0.069 | 0.160 | 0.037 |
| 5. 1.5 mg/kg AC007201 | 1.000 | 0.000 | 0.395 | 0.142 | 0.337 | 0.120 |
| 6. 1.5 mg/kg AC004201 | 1.000 | 0.000 | 0.324 | 0.090 | 0.255 | 0.057 |
| 7. 1.5 mg/kg AC007202 | 1.000 | 0.000 | 0.286 | 0.109 | 0.236 | 0.092 |
| 8. 1.5 mg/kg AC007203 | 1.000 | 0.000 | 0.187 | 0.032 | 0.191 | 0.039 |
| 9. 1.5 mg/kg AC007204 | 1.000 | 0.000 | 0.199 | 0.069 | 0.191 | 0.041 |

Groups 2-9 showed reduction in ALK7-GLuc at all time points (Day 8 and Day 15) compared to the saline control Group 1. In particular, AC007200 achieved ~84% inhibition (0.160) at 1.5 mg/kg on Day 15.

Example 24. In Vivo Administration of ALK7 RNAi Agents in ALK7-Gluc-AAV Mice

The ALK7-GLuc-AAV model as described in Example 6, above, was used. On Day −21, six (n=6) male C57bl/6 mice in each group were dosed with ~4×10^12 GC/kg ALK7-GLuc AAV8, via intravenous IV injection, at 250 μL per 25 g body weight injection volume. On Day 1, the mice were dosed with either saline or ALK7 RNAi agents formulated in saline (at 1.5 mg/kg), via subcutaneous (SQ) injection, at 250 μL per 25 g body weight injection volume. The dosing regimen was in accordance with Table 49 below.

TABLE 49

Dosing Groups of Example 24.

| Group ID | RNAi Agent | Dose | Dosing Regimen | # of Animals (n =) |
|---|---|---|---|---|
| 1 | Saline | N/A | Day 1 SQ Injection | n = 6 |
| 2 | AC005847 | 1.5 mg/kg | Day 1 SQ Injection | n = 6 |
| 3 | AC008318 | 1.5 mg/kg | Day 1 SQ Injection | n = 6 |
| 4 | AC008319 | 1.5 mg/kg | Day 1 SQ Injection | n = 6 |
| 5 | AC008320 | 1.5 mg/kg | Day 1 SQ Injection | n = 6 |
| 6 | AC008321 | 1.5 mg/kg | Day 1 SQ Injection | n = 6 |
| 7 | AC008322 | 1.5 mg/kg | Day 1 SQ Injection | n = 6 |
| 8 | AC008323 | 1.5 mg/kg | Day 1 SQ Injection | n = 6 |
| 9 | AC008324 | 1.5 mg/kg | Day 1 SQ Injection | n = 6 |
| 10 | AC008325 | 1.5 mg/kg | Day 1 SQ Injection | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 50, with average GLuc reflecting the normalized average value of GLuc. Inhibition of ALK7 expression by an ALK7 RNAi agent results in concomitant inhibition of GLuc expression, which is measured.

TABLE 50

Average GLuc normalized to pre-treatment and saline control in ALK7-Gluc AAV mice of Example 24.

| | Day 1 | | Day 8 | | Day 15 | |
|---|---|---|---|---|---|---|
| Group ID | Avg GLuc | Std Dev | Avg GLuc | Std Dev | Avg GLuc | Std Dev |
| 1. Saline | 1.000 | 0.000 | 1.000 | 0.111 | 1.000 | 0.167 |
| 2. 1.5 mg/kg AC005847 | 1.000 | 0.000 | 0.135 | 0.050 | 0.079 | 0.029 |
| 3. 1.5 mg/kg AC008318 | 1.000 | 0.000 | 0.170 | 0.048 | 0.146 | 0.055 |
| 4. 1.5 mg/kg AC008319 | 1.000 | 0.000 | 0.235 | 0.046 | 0.146 | 0.037 |
| 5. 1.5 mg/kg AC008320 | 1.000 | 0.000 | 0.180 | 0.046 | 0.144 | 0.052 |
| 6. 1.5 mg/kg AC008321 | 1.000 | 0.000 | 0.301 | 0.049 | 0.248 | 0.027 |
| 7. 1.5 mg/kg AC008322 | 1.000 | 0.000 | 0.247 | 0.082 | 0.230 | 0.078 |
| 8. 1.5 mg/kg AC008323 | 1.000 | 0.000 | 0.476 | 0.097 | 0.524 | 0.080 |
| 9. 1.5 mg/kg AC008324 | 1.000 | 0.000 | 0.224 | 0.046 | 0.161 | 0.023 |
| 10. 1.5 mg/kg AC008325 | 1.000 | 0.000 | 0.144 | 0.044 | 0.145 | 0.042 |

Groups 2-10 showed reduction in ALK7-GLuc at all time points (Day 8 and Day 15) compared to the saline control Group 1. In particular, AC005847 achieved ~92% inhibition (0.079) at 1.5 mg/kg on Day 15.

Example 25. In Vivo Administration of ALK7 RNAi Agents in ALK7-Gluc-AAV Mice

The ALK7-GLuc-AAV model as described in Example 6, above, was used. On Day −21, five (n=5) male C57bl/6 mice in each group were dosed with ~4×10^12 GC/kg ALK7-GLuc AAV8, via intravenous IV injection, at 250 µL per 25 g body weight injection volume. On Day 1, the mice were dosed with either saline or ALK7 RNAi agents formulated in saline (at 0.25, 0.5, or 1.5 mg/kg), via subcutaneous (SQ) injection, at 250 µL per 25 g body weight injection volume. The dosing regimen was in accordance with Table 51 below.

TABLE 51

Dosing Groups of Example 25.

| Group ID | RNAi Agent | Dose | Dosing Regimen | # of Animals (n=) |
|---|---|---|---|---|
| 1 | Saline | N/A | Day 1 SQ Injection | n = 5 |
| 2 | AC004201 | 0.25 mg/kg | Day 1 SQ Injection | n = 5 |
| 3 | AC004201 | 0.5 mg/kg | Day 1 SQ Injection | n = 5 |
| 4 | AC004201 | 1.5 mg/kg | Day 1 SQ Injection | n = 5 |
| 5 | AC006746 | 0.25 mg/kg | Day 1 SQ Injection | n = 5 |
| 6 | AC006746 | 0.5 mg/kg | Day 1 SQ Injection | n = 5 |
| 7 | AC006746 | 1.5 mg/kg | Day 1 SQ Injection | n = 5 |
| 8 | AC006305 | 0.25 mg/kg | Day 1 SQ Injection | n = 5 |
| 9 | AC006305 | 0.5 mg/kg | Day 1 SQ Injection | n = 5 |
| 10 | AC006305 | 1.5 mg/kg | Day 1 SQ Injection | n = 5 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the ALK7 RNAi agents included modified nucleotides that were conjugated at the 5' terminal end of the sense strand to a targeting ligand that included three N-acetyl-galactosamine groups (tridentate ligand) having the modified sequences as set forth in the duplex structures herein (see Tables 3, 4, 5, 6, 7A, 7B, and 8 for specific modifications and structure information related to the ALK7 RNAi agents; see Table 11 for structure of (NAG37) and (NAG37)s ligand).

GLuc levels were determined pursuant to the procedure set forth in Example 6, above. Data from the experiment are shown in the following Table 52, with average GLuc reflecting the normalized average value of GLuc. Inhibition of ALK7 expression by an ALK7 RNAi agent results in concomitant inhibition of GLuc expression, which is measured.

TABLE 52

Average GLuc normalized to pre-treatment and saline control in ALK7-Gluc AAV mice of Example 25.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.151 | 1.000 | 0.220 | 1.000 | 0.112 |
| 2. 0.25 mg/kg AC004201 | 0.882 | 0.266 | 0.751 | 0.371 | 0.701 | 0.262 |
| 3. 0.5 mg/kg AC004201 | 0.502 | 0.190 | 0.433 | 0.146 | 0.405 | 0.195 |
| 4. 1.5 mg/kg AC004201 | 0.344 | 0.072 | 0.291 | 0.078 | 0.293 | 0.080 |
| 5. 0.25 mg/kg AC006746 | 0.849 | 0.205 | 0.781 | 0.215 | 0.721 | 0.162 |
| 6. 0.5 mg/kg AC006746 | 0.558 | 0.220 | 0.485 | 0.110 | 0.428 | 0.166 |
| 7. 1.5 mg/kg AC006746 | 0.326 | 0.063 | 0.307 | 0.072 | 0.319 | 0.047 |
| 8. 0.25 mg/kg AC006305 | 0.566 | 0.064 | 0.677 | 0.134 | 0.639 | 0.099 |
| 9. 0.5 mg/kg AC006305 | 0.421 | 0.086 | 0.435 | 0.095 | 0.438 | 0.122 |
| 10. 1.5 mg/kg AC006305 | 0.271 | 0.034 | 0.231 | 0.043 | 0.236 | 0.010 |

Groups 2-10 showed reduction in ALK7-GLuc at all time points (Day 8, Day 15, and Day 22) compared to the saline control Group 1. In particular, AC006305 achieved ~77% inhibition (0.231) at 1.5 mg/kg on Day 15. A dose-response was observed for AC004201, AC006746, and AC006305 at all time points (Day 8, Day 15, and Day 22).

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (655 sequences)

SEQ ID NO: 1 - RNA, 8853 nt, Homo sapiens
  source 1..8853: mol_type = mRNA
agtggcaggagcgccgcgcaccgccagccgcagggggcgtgggatgggggcggccggggaggggggcgcccacactgactagagccaaccgcgcacttcaaaagggtgtcggtgccgcgctcccctcccgcggcccgggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggactgaagtgtgtatgtcttttgtgtgattcttcaaacttcacctgccaaacagaaggagcatgttgggcatcagtcatgctaaccaatggaaaagagcaggtgatcaaatcctgtgtctcccttccagaactgaatgctcaagtcttctgtcatagttccaacaatgttaccaaaaccgaatgctgcttcacagatttttgcaacaacataacactgcaccttccaacagcatcaccaaatgccccaaaacttggacccatggagctggccatcattattactgtgcctgtttgcctcctgtccatagctgcgatgctgacagtatgggcatgccagggtcgacagtgctcctacaggaagaaaaagagaccaaatgtggaggaaccactctctgagtgcaatctggtaaatgctggaaaaactctgaaagatctgatttatgatgtgaccgcctctggatctggctctggtctacctctgttggttcaaaggacaattgcaaggacgattgtgcttcaggaaatagtaggaaaaggtagatttggtgaggtgtggcatggaagatggtgtggggaagatgtggctgtgaaaatattctcctccagagatgaaagatcttggtttcgtgaggcagaaatttaccagacggtcatgctgcgacatgaaaacatccttggtttcattgctgctgacaacaaagataatggaacttggactcaactttggctggtatctgaatatcatgaacagggctccttatatgactatttgaatagaaatatagtgaccgtggctggaatgatcaagctggcgctctcaattgctagtggtctggcacaccttcatatggagattgttggtacacaaggtaaacctgctattgctcatcgagacataaaatcaaagaatatcttagtgaaaaagtgtgaaacttgtgccatagcggacttagggttggctgtgaagcatgattcaatactgaacactatcgacatacctcagaatcctaaagtgggaaccaagaggtatatggctcctgaaatgcttgatgatacaatgaatgtgaatatctttgagtccttcaaacgagctgacatctattctgttggtctggtttactgggaaatagcccggaggtgttcagtcggaggaattgttgaggagtaccaattgccttattatgacatggtgccttcagatccctcgatagaggaaatgagaaaggttgtttgtgaccagaagtttcgaccaagtatcccaaaccagtggcaaagttgtgaagcactccgagtcatggggagaataatgcgtgagtgttggtatgccaacggagcggcccgcctaactgctcttcgtattaagaagactatatctcaactttgtgtcaaagaagactgcaaagcctaatgatgataattatgttaaaaagaaatctctcatagctttcttttccattttcccctttatgtgaatgtttttgccattttttttttgttctacctcaaagataagacagtacagtatttaagtgcccataaggcagcatgaaaagataactctaaagttaagcatgggcaggagttgacttcatccaatctctatgttatgtttaattttattttgaaagcaacacctcaactcatctttttatttaataaggaagaaatatattacaaaagtataaaataagctctataaaaatgttatagtcattaagtttttattttacttgaaccaagagcacatgaatgaacaggaaaagatgtaaaaacatttttttctgagatgaaaacatattaattaaacatgcaaattagagcatgctatctttaggtgatgcaatctatgtttccccctttttaagttagcaggactttttaaaaataaatattgctctaaactttaatatatcgaacgtgagagtggagctgcttagtggaagatgtaagtgaggtgggtgtcccatgtgcttggtctccccttctgctgttctcctgttcttcataatccactactgcagcagtccctgaaccactaaacttgttcctttcatttacaaaagagatacctgacatcctgagacactgagaaatgtcctgaagtcacacagctaatggcagaactggcactaggtccaaatcttgtgataatgaacaccgtaaggttagctagcttcctactttcccttgaatagtgcttttctccctatgtaatatcttttattatgatatttgtggtttagaaggcatattgagttattttgcagaatcataatggacccgcacaaaatctcagaaccatatctgttgacattttttctcatagaaatatcatggttaccccatttgttaatgagcattaatgttttctgaacacttccaaagattaatcaaacataaatattcattgtctgaaaatgtctttaagatacaattcagaggtccctatttcctttgtacatacacacttagaaagaaaagacagaaaaggaagaggaaggaaggaaatattttgagaatatattgagaagaattaagaaaactcttcaatgaagtgttaacaaccaaaccctacagacggtatcagaaacagcaaatagatattcctctaccctttcacagtgagtgagtgagtacagaagaatgctcatgatagttttgccttcattctactttctgtggacacagagtaatgaatatttaatgggacattaaatatgcccttcaaatctataattttactttggtaaacgagatttaacatgatgtcttttatgctcctaaaacatcttttttcaaactccattccttagaacattcttctactgagatgatccaagaccaaaagtgttctttggtacttgcttataaagtgatagtacatgttagcatataatgtattttgaagagtgaagtaaatgctattgataacagtaaaaaaaaaaaaaaaaactaataacagtaaagaaatgctacttgatttttttttaaactggattgctcagattacctgatcgtggtggaacccttttattaagaggaggggaaactttttactatcccatatttaactgttctataaagcaaagcacagcttgggtaatagcgttctgaaggatatacttctgtattttctcatagagtacaatttagtgattatgcttcatttcactatggaaatatgttactgaatctatcttcattttactgagttgaaataaggaaggcaaaaaactgacagctatggagtttgcgtgtacttccatactcgttaatgctctcatccacttattaaataatcatagagcacccatatcttgcttgccacaatatcgggtacaagagggaatacaaagatagataggtcctgccctcagggattttaaagtctaatttgggaatgggaatagggatgtgagtgtgtgggggaagagattaaattgacagataaaatacgaagtgggatgtcttgagttctgcatgacagtgggtttctaggataggtctgaaaattgctttcatttgcaacacatttagaaagtagctttatttggatattacagacaatctaaatatatcatcagtttttaaaagtgcctatgtgaagtgatttttaaaaagagcctatgtgaaggggtaatcttgcttgttcttgttactaatttctcatagattgtttttctgcatatataagaacgaaattatttatttactatggttgtacgtgcctcaaataaacaagaatgatatttcctgttttatttacttatgttgggtaaatatgcttattgaatttttaagagaggattttttaccatctccatttttcttgtcattatgttttgtagcttatttgagggtgtctaaatataatttcatattttattggttcaactttcactctgaagaaatccgtatgttagtacattttgaggtatttttcttgttcttgtgttgtttaactatgactcctaactgagtagtcttatatttcaattacaaaatacattttttaagaaagggaatagagcagcaaaaatgataaggaaaatgttaaaagttgtaatatttcctttactcttaacaggattatatatagaacatgctcacttacaaaaataggatgatgaagtttagagcataaggcaggcttcttgtatatacttatgctgtcaaatgttatattgtttttaatggagtcccattgtgtaatatttatttcttttacattttgttataagcaaaaaaaaaaaaaattctccttaggttatgttcagagtatcagtgttctttactccttacagatattttggctttggggtataatacaagacttgggaaaacactattatgaattttcagtactgtataaagtggtgatgggatttaaatgcagcatcactttctgaaaataagagaaacattatttgttgtcagtatttcagcatgaacttgttgccttgtaaattttgcctttaagtttgtaattggtacagattctgttgtatgctttcttctatgtctaaaatatttggcatgtcacatctagaattcttaatttatgttctgacttgagagttaagtgaaacatgactgtcgtgcactattttaggcatagcacttgcttttcatctttatactttcaattaactttgcattttaaatttccatgattgtatgaaaatagtaacctggttgcagtatctgaaaaaattaaaattagcttttatttaaaaatgaaaatctacaatagattcattaggttagaagttccagaataatttattattttattacacctactattgtagaattactaataaaacaaaacaaaactactcctattttcctggaattttgccaccatgtgacttattggggcagagaaaactcagggttgtctttgagtctgcacaaaagcaccagggaacctgcttagcaaatcgtctgaaaacagggagctgatgtttgccattatacaaagtttgagtaaacaacttaaaattgcttgttagggcatagtctttgattgaaataagtatgagaatgtatttggctaaataaatgtatttaaaatatacaaattttatttcccactggaaaattaagaaagtagcagtaccaaatgaataaaagctggcagttgatgtcttcaataatcattcctttaaaataaattcacaaacacatcattacaagctacttagaaatgtttagtattcgtatcttaaaatggcaccattgtggttttcaaagatattttaaacatcttttgtgaaacatactatttctgtttgacaatgctttgttctagctctgtgtgctgatacctacatggagtttttctgctattttagtgaaaacagtaattcttttatcttgagagctgcttctaaataacaaaaaagttaattggaatgtaagtttttaaaaaatgttaatattaaatagaatttttataatatgggcatttttcaaaacattttaatgaaaatatatagatatttgactttctttttttcatctagccttgctttatatttcattatttttctcactttttttcttaatattccctcactatctttcaacattatcattagttcctaattttaaaaataactcttatttaacttaaccgtctggaatttagccttctaatgaaagagaatcccttagtactctcagagattatataaagttattccaattttgtgtagatgacgaaaccaaggatcagagattaaatgactactagttactagcagaactcttatgaaagcctggtggtgacacccagcactgttccctgccatatccccaacttttactgattaaaaattaattcgcatgcatctaaacctaccttgaatgcacactaacgtaatgtgccattcaatgatgatgataaaatcccacttttctttgggtttctactaaaataatttactcactcagagtgaggtcaatgagaaaaactaaactaggctaagaaagagttgtagaatggttgttgagctaagtaggcaaccactggggtgctgataaaattaatggataaaatttaggaactgtgagagtatagaatttcttagtgcaagtaatgattagagaagcttcctgacatcccccaccctttctgtaaggactgttctttctctttgtaccttggaatgggggtgaaaggtgatttgatagctgaatttgggactatgtccagtgggatattatctaacttttctctctttctcttttttttcccctcagtttctcattagtttgtctttggcattcatcttcttttagtgcattaaaaaatgtttggcagatctcatcaatcccaagtcactctataattcctgtatttctttagttgtcgtttaacctgtccaaacttctacacaatgaacttcttaacaagattttaagttctctgtataagaggtttcacctcataacttctccagtaatccttcatttggcactatagagtatttgttaatggcagagatgatttttcttttaaaacctaaaaagactagctgttatttgtattctagcttttagctaacatataaagaatgtctacttttgctttaatgctaaattccgcttgagaaatagtaactgggaaagacaatttgaaatatatgccccataatgtgattgttaaatttatttctgctgttccataccattgctttgttttgcttttgacaaactaagccattatgctattagtttggaatataatactacagcaaaattaggtaacaatccctattttaaaattcccctaacaataatagaactgccagcatacttttctctttcagttgtagatgaatacattcgagagaatatgagctgtatttcatcctagattttaatattttcagatgtgactgtatttcctgatcattggtccaagttgtcctaaaagaaatttttctctccagacctaacagttttaactgcaagagtttactgtgggttatgttaatctgaattttaatagggccactaagaatctgagtgccttaggagattacccttatacccactgccatcacatccagtcaggcctgttgtgctctatataaatcttcccagctgaggggcaggtgcgggctaaaatccaactgcaattggctcccagacataattttatattttacagagaagcatcttattggcttatatgtgtttaaagaatggtctggcttatacatcttcagaaaatgagaattaaaaagtcaaaataattcttgacatctacagattgaacaaagaacttagaagaaataatactttatcttttcatcctggcattcctgagagaagagaaattgattgtttatcatgttggtttaatttttcaacccagacaatctgcagcaaggcacatggaccccaattttgatatcgtccatacagttttcattctatgcatggagctaattactgactttgcctgtaaagagaggattgtgtgcctaaattttgtctaacaaatgcaagcgtagaatgacatttactaatatttctatttcttccataggctaaataatagtaactaagtatttttaaggacacagccctttttttctctttatacaaaatgagagtatctgagccaaaatattaaattctagttcttttccgcaatgactagtgtcaagctcatgtactcttctgattctagactggagaagattattcaaacttgatctgtgtttcaggtttttaaatgtcctaaaaacagaaaattagattcagatctcaaaaaaggaattttggattgactttcaaagtactaatactaattatacttttcttttggtagcgtgactcttcttatacctaagaacatattacaaatgtcaaaaccattgcattttgacattgcaaaacatgccttgaactcttgaactactgtgaaaagaatcaccgttgtaaagactttttgtaagctagctgatactcttaagtatgtaaaaagattgtctttcagccgacaggcccaaaggaatgtatataaggaaggaatatgaaaaaataaattaggttttaaaataggaattgggcaataaactgtatcaaaaatatgtagatggattttagtagttgtaatttaaatgtggaaggtgaagagaatttcaaactccaaagagaaatgaatgatattcagatgtttcattaatttctagtctgtgaaaatatgcattttatagtaatatgtatagacttattttatttagaaataatagtgttttagaatttattaaaaactcagtgatagcctttataccaaaatgtttaactttaccaacagcaagtcataaaagtatttattttaaagctttttaatattatcgtgtaactttcatctgtcttcagatgtaaataattatctgcctaaatgttatatttttatgtatgcattttctgaaaatgtattgttttgtaaagtgggaaagataataaatcaagcacttcttgcacttgtttctgtgaagcatatagaactctattttaaataaaggaagatgtgtcgta

SEQ ID NO: 2 - RNA, 19 nt, synthetic construct
  source 1..19: mol_type = other RNA
actgaagtgtgtatgtctt

SEQ ID NO: 3 - RNA, 19 nt, synthetic construct
  source 1..19: mol_type = other RNA
aacagaaggagcatgttgg

SEQ ID NO: 4 - RNA, 19 nt, synthetic construct
  source 1..19: mol_type = other RNA
gtcatgctaaccaatggaa

SEQ ID NO: 5 - RNA, 19 nt, synthetic construct
  source 1..19: mol_type = other RNA
cttctgtcatagttccaac

SEQ ID NO: 6 - RNA, 19 nt, synthetic construct
  source 1..19: mol_type = other RNA
ctgtcatagttccaacaat

SEQ ID NO: 7 - RNA, 19 nt, synthetic construct
  source 1..19: mol_type = other RNA
tggtatctgaatatcatga

SEQ ID NO: 8 - RNA, 19 nt, synthetic construct
  source 1..19: mol_type = other RNA
aacagggctccttatatga

SEQ ID NO: 9 - RNA, 19 nt, synthetic construct
  source 1..19: mol_type = other RNA
gtctggcacaccttcatat

SEQ ID NO: 10 - RNA, 19 nt, synthetic construct
  source 1..19: mol_type = other RNA
ctggcacaccttcatatgg

SEQ ID NO: 11 - RNA, 19 nt, synthetic construct
  source 1..19: mol_type = other RNA
ggcacaccttcatatggag

SEQ ID NO: 12 - RNA, 19 nt, synthetic construct
  source 1..19: mol_type = other RNA
acaaggtaaacctgctatt

SEQ ID NO: 13 - RNA, 19 nt, synthetic construct
  source 1..19: mol_type = other RNA
aggtaaacctgctattgct

SEQ ID NO: 14 - RNA, 19 nt, synthetic construct
  source 1..19: mol_type = other RNA
gtgccatagcggacttagg

SEQ ID NO: 15 - RNA, 19 nt, synthetic construct
  source 1..19: mol_type = other RNA
ctgtgaagcatgattcaat

SEQ ID NO: 16 - RNA, 19 nt, synthetic construct
  source 1..19: mol_type = other RNA
tgtgaagcatgattcaata

SEQ ID NO: 17 - RNA, 19 nt, synthetic construct
  source 1..19: mol_type = other RNA
aatactgaacactatcgac

SEQ ID NO: 18 - RNA, 19 nt, synthetic construct
  source 1..19: mol_type = other RNA
tcgacatacctcagaatcc

SEQ ID NO: 19 - RNA, 19 nt, synthetic construct
  source 1..19: mol_type = other RNA
tgaaatgcttgatgataca

SEQ ID NO: 20 - RNA, 19 nt, synthetic construct
  source 1..19: mol_type = other RNA
aatgcttgatgatacaatg

SEQ ID NO: 21 - RNA, 19 nt, synthetic construct
  source 1..19: mol_type = other RNA
cgagctgacatctattctg

SEQ ID NO: 22 - RNA, 19 nt, synthetic construct
  source 1..19: mol_type = other RNA
ctgttggtctggtttactg

SEQ ID NO: 23 - RNA, 19 nt, synthetic construct
  source 1..19: mol_type = other RNA
gttgaggagtaccaattgc

SEQ ID NO: 24 - RNA, 19 nt, synthetic construct
  source 1..19: mol_type = other RNA
tcagatccctcgatagagg

SEQ ID NO: 25 - RNA, 19 nt, synthetic construct
  source 1..19: mol_type = other RNA
atccctcgatagaggaaat

SEQ ID NO: 26 - RNA, 19 nt, synthetic construct
  source 1..19: mol_type = other RNA
aagtttcgaccaagtatcc

SEQ ID NO: 27 - RNA, 19 nt, synthetic construct
  source 1..19: mol_type = other RNA
actgctcttcgtattaaga

SEQ ID NO: 28 - RNA, 19 nt, synthetic construct
  source 1..19: mol_type = other RNA
aagacatacacacttcagt

SEQ ID NO: 29 - RNA, 19 nt, synthetic construct
  source 1..19: mol_type = other RNA
tagacatacacacttcagt

SEQ ID NO: 30 - RNA, 19 nt, synthetic construct
  source 1..19: mol_type = other RNA
nagacatacacacttcagt

SEQ ID NO: 31 - RNA, 19 nt, synthetic construct
  source 1..19: mol_type = other RNA
nagacatacacacttcagn

SEQ ID NO: 32 - RNA, 19 nt, synthetic construct
  source 1..19: mol_type = other RNA
ccaacatgctccttctgtt

SEQ ID NO: 33 - RNA, 19 nt, synthetic construct
  source 1..19: mol_type = other RNA
tcaacatgctccttctgtt

SEQ ID NO: 34 - RNA, 19 nt, synthetic construct
  source 1..19: mol_type = other RNA
acaacatgctccttctgtt

SEQ ID NO: 35 - RNA, 19 nt, synthetic construct
  source 1..19: mol_type = other RNA
ncaacatgctccttctgtt

SEQ ID NO: 36 - RNA, 19 nt, synthetic construct
  source 1..19: mol_type = other RNA
ncaacatgctccttctgtn

SEQ ID NO: 37 - RNA, 19 nt, synthetic construct
  source 1..19: mol_type = other RNA
ttccattggttagcatgac

SEQ ID NO: 38 - RNA, 19 nt, synthetic construct
  source 1..19: mol_type = other RNA
atccattggttagcatgac

SEQ ID NO: 39 - RNA, 19 nt, synthetic construct
  source 1..19: mol_type = other RNA
ntccattggttagcatgac

SEQ ID NO: 40 - RNA, 19 nt, synthetic construct
  source 1..19: mol_type = other RNA
ntccattggttagcatgan

SEQ ID NO: 41 - RNA, 19 nt, synthetic construct
  source 1..19: mol_type = other RNA
gttggaactatgacagaag

SEQ ID NO: 42 - RNA, 19 nt, synthetic construct
  source 1..19: mol_type = other RNA
tttggaactatgacagaag

SEQ ID NO: 43 - RNA, 19 nt, synthetic construct
  source 1..19: mol_type = other RNA
attggaactatgacagaag

SEQ ID NO: 44 - RNA, 19 nt, synthetic construct
  source 1..19: mol_type = other RNA
nttggaactatgacagaag

SEQ ID NO: 45 - RNA, 19 nt, synthetic construct
  source 1..19: mol_type = other RNA
nttggaactatgacagaan

SEQ ID NO: 46 - RNA, 19 nt, synthetic construct
  source 1..19: mol_type = other RNA
attgttggaactatgacag

SEQ ID NO: 47 - RNA, 19 nt, synthetic construct
  source 1..19: mol_type = other RNA
tttgttggaactatgacag

SEQ ID NO: 48 - RNA, 19 nt, synthetic construct
  source 1..19: mol_type = other RNA
nttgttggaactatgacag

SEQ ID NO: 49 - RNA, 19 nt, synthetic construct
  source 1..19: mol_type = other RNA
nttgttggaactatgacan

SEQ ID NO: 50 - RNA, 19 nt, synthetic construct
  source 1..19: mol_type = other RNA
tcatgatattcagatacca

SEQ ID NO: 51 - RNA, 19 nt, synthetic construct
  source 1..19: mol_type = other RNA
acatgatattcagatacca

SEQ ID NO: 52 - RNA, 19 nt, synthetic construct
  source 1..19: mol_type = other RNA
ncatgatattcagatacca

SEQ ID NO: 53 - RNA, 19 nt, synthetic construct
  source 1..19: mol_type = other RNA
ncatgatattcagataccn

SEQ ID NO: 54 - RNA, 19 nt, synthetic construct
  source 1..19: mol_type = other RNA
tcatataaggagccctgtt

SEQ ID NO: 55 - RNA, 19 nt, synthetic construct
  source 1..19: mol_type = other RNA
acatataaggagccctgtt

SEQ ID NO: 56 - RNA, 19 nt, synthetic construct
  source 1..19: mol_type = other RNA
ncatataaggagccctgtt

SEQ ID NO: 57 - RNA, 19 nt, synthetic construct
  source 1..19: mol_type = other RNA
ncatataaggagccctgtn

SEQ ID NO: 58 - RNA, 19 nt, synthetic construct
  source 1..19: mol_type = other RNA
atatgaaggtgtgccagac

SEQ ID NO: 59 - RNA, 19 nt, synthetic construct
  source 1..19: mol_type = other RNA
ttatgaaggtgtgccagac

SEQ ID NO: 60 - RNA, 19 nt, synthetic construct
  source 1..19: mol_type = other RNA
ntatgaaggtgtgccagac

SEQ ID NO: 61 - RNA, 19 nt, synthetic construct
  source 1..19: mol_type = other RNA
ntatgaaggtgtgccagan

SEQ ID NO: 62 - RNA, 19 nt, synthetic construct
  source 1..19: mol_type = other RNA
ccatatgaaggtgtgccag

SEQ ID NO: 63 - RNA, 19 nt, synthetic construct
  source 1..19: mol_type = other RNA
tcatatgaaggtgtgccag

SEQ ID NO: 64 - RNA, 19 nt, synthetic construct
  source 1..19: mol_type = other RNA
acatatgaaggtgtgccag

SEQ ID NO: 65 - RNA, 19 nt, synthetic construct
  source 1..19: mol_type = other RNA
ncatatgaaggtgtgccag

SEQ ID NO: 66 - RNA, 19 nt, synthetic construct
  source 1..19: mol_type = other RNA
ncatatgaaggtgtgccan

SEQ ID NO: 67 - RNA, 19 nt, synthetic construct
  source 1..19: mol_type = other RNA
ctccatatgaaggtgtgcc

SEQ ID NO: 68 - RNA, 19 nt, synthetic construct
  source 1..19: mol_type = other RNA
ttccatatgaaggtgtgcc

SEQ ID NO: 69 - RNA, 19 nt, synthetic construct
  source 1..19: mol_type = other RNA
atccatatgaaggtgtgcc

SEQ ID NO: 70 - RNA, 19 nt, synthetic construct
  source 1..19: mol_type = other RNA
ntccatatgaaggtgtgcc

SEQ ID NO: 71 - RNA, 19 nt, synthetic construct
  source 1..19: mol_type = other RNA
ntccatatgaaggtgtgcn

SEQ ID NO: 72 - RNA, 19 nt, synthetic construct
  source 1..19: mol_type = other RNA
aatagcaggtttaccttgt

SEQ ID NO: 73 - RNA, 19 nt, synthetic construct
  source 1..19: mol_type = other RNA
tatagcaggtttaccttgt

SEQ ID NO: 74 - RNA, 19 nt, synthetic construct
  source 1..19: mol_type = other RNA
natagcaggtttaccttgt

SEQ ID NO: 75 - RNA, 19 nt, synthetic construct
  source 1..19: mol_type = other RNA
natagcaggtttaccttgn

SEQ ID NO: 76 - RNA, 19 nt, synthetic construct
  source 1..19: mol_type = other RNA
agcaatagcaggtttacct

SEQ ID NO: 77 - RNA, 19 nt, synthetic construct
  source 1..19: mol_type = other RNA
tgcaatagcaggtttacct

SEQ ID NO: 78 - RNA, 19 nt, synthetic construct
  source 1..19: mol_type = other RNA
ngcaatagcaggtttacct

SEQ ID NO: 79 - RNA, 19 nt, synthetic construct
  source 1..19: mol_type = other RNA
ngcaatagcaggtttaccn

SEQ ID NO: 80 - RNA, 19 nt, synthetic construct
  source 1..19: mol_type = other RNA
cctaagtccgctatggcac

SEQ ID NO: 81 - RNA, 19 nt, synthetic construct
  source 1..19: mol_type = other RNA
tctaagtccgctatggcac

SEQ ID NO: 82 - RNA, 19 nt, synthetic construct
  source 1..19: mol_type = other RNA
actaagtccgctatggcac

SEQ ID NO: 83 - RNA, 19 nt, synthetic construct
  source 1..19: mol_type = other RNA
nctaagtccgctatggcac

SEQ ID NO: 84 - RNA, 19 nt, synthetic construct
  source 1..19: mol_type = other RNA
nctaagtccgctatggcan

SEQ ID NO: 85 - RNA, 19 nt, synthetic construct
  source 1..19: mol_type = other RNA
attgaatcatgcttcacag

SEQ ID NO: 86 - RNA, 19 nt, synthetic construct
  source 1..19: mol_type = other RNA
tttgaatcatgcttcacag

SEQ ID NO: 87 - RNA, 19 nt, synthetic construct
  source 1..19: mol_type = other RNA
nttgaatcatgcttcacag

SEQ ID NO: 88 - RNA, 19 nt, synthetic construct
  source 1..19: mol_type = other RNA
nttgaatcatgcttcacan

SEQ ID NO: 89 - RNA, 19 nt, synthetic construct
  source 1..19: mol_type = other RNA
tattgaatcatgcttcaca

SEQ ID NO: 90 - RNA, 19 nt, synthetic construct
  source 1..19: mol_type = other RNA
aattgaatcatgcttcaca

SEQ ID NO: 91 - RNA, 19 nt, synthetic construct
  source 1..19: mol_type = other RNA
nattgaatcatgcttcaca

SEQ ID NO: 92 - RNA, 19 nt, synthetic construct
  source 1..19: mol_type = other RNA
nattgaatcatgcttcacn

SEQ ID NO: 93 - RNA, 19 nt, synthetic construct
  source 1..19: mol_type = other RNA
gtcgatagtgttcagtatt

SEQ ID NO: 94 - RNA, 19 nt, synthetic construct
  source 1..19: mol_type = other RNA
ttcgatagtgttcagtatt

SEQ ID NO: 95 - RNA, 19 nt, synthetic construct
  source 1..19: mol_type = other RNA
atcgatagtgttcagtatt

SEQ ID NO: 96 - RNA, 19 nt, synthetic construct
  source 1..19: mol_type = other RNA
ntcgatagtgttcagtatt

SEQ ID NO: 97 - RNA, 19 nt, synthetic construct
  source 1..19: mol_type = other RNA
ntcgatagtgttcagtatn

SEQ ID NO: 98 - RNA, 19 nt, synthetic construct
  source 1..19: mol_type = other RNA
ggattctgaggtatgtcga

SEQ ID NO: 99 - RNA, 19 nt, synthetic construct
  source 1..19: mol_type = other RNA
tgattctgaggtatgtcga

SEQ ID NO: 100 - RNA, 19 nt, synthetic construct
  source 1..19: mol_type = other RNA
agattctgaggtatgtcga

SEQ ID NO: 101 - RNA, 19 nt, synthetic construct
  source 1..19: mol_type = other RNA
ngattctgaggtatgtcga

SEQ ID NO: 102 - RNA, 19 nt, synthetic construct
  source 1..19: mol_type = other RNA
ngattctgaggtatgtcgn

SEQ ID NO: 103 - RNA, 19 nt, synthetic construct
  source 1..19: mol_type = other RNA
tgtatcatcaagcatttca

SEQ ID NO: 104 - RNA, 19 nt, synthetic construct
  source 1..19: mol_type = other RNA
agtatcatcaagcatttca

SEQ ID NO: 105 - RNA, 19 nt, synthetic construct
  source 1..19: mol_type = other RNA
ngtatcatcaagcatttca

SEQ ID NO: 106 - RNA, 19 nt, synthetic construct
  source 1..19: mol_type = other RNA
ngtatcatcaagcatttcn

SEQ ID NO: 107 - RNA, 19 nt, synthetic construct
  source 1..19: mol_type = other RNA
cattgtatcatcaagcatt

SEQ ID NO: 108 - RNA, 19 nt, synthetic construct
  source 1..19: mol_type = other RNA
tattgtatcatcaagcatt

SEQ ID NO: 109 - RNA, 19 nt, synthetic construct
  source 1..19: mol_type = other RNA
aattgtatcatcaagcatt

SEQ ID NO: 110 - RNA, 19 nt, synthetic construct
  source 1..19: mol_type = other RNA
nattgtatcatcaagcatt

SEQ ID NO: 111 - RNA, 19 nt, synthetic construct
  source 1..19: mol_type = other RNA
nattgtatcatcaagcatn

SEQ ID NO: 112 - RNA, 19 nt, synthetic construct
  source 1..19: mol_type = other RNA
cagaatagatgtcagctcg

SEQ ID NO: 113 - RNA, 19 nt, synthetic construct
  source 1..19: mol_type = other RNA
tagaatagatgtcagctcg

SEQ ID NO: 114 - RNA, 19 nt, synthetic construct
  source 1..19: mol_type = other RNA
aagaatagatgtcagctcg

SEQ ID NO: 115 - RNA, 19 nt, synthetic construct
  source 1..19: mol_type = other RNA
nagaatagatgtcagctcg

SEQ ID NO: 116 - RNA, 19 nt, synthetic construct
  source 1..19: mol_type = other RNA
nagaatagatgtcagctcn

SEQ ID NO: 117 - RNA, 19 nt, synthetic construct
  source 1..19: mol_type = other RNA
cagtaaaccagaccaacag

SEQ ID NO: 118 - RNA, 19 nt, synthetic construct
  source 1..19: mol_type = other RNA
tagtaaaccagaccaacag

SEQ ID NO: 119 - RNA, 19 nt, synthetic construct
  source 1..19: mol_type = other RNA
aagtaaaccagaccaacag

SEQ ID NO: 120 - RNA, 19 nt, synthetic construct
  source 1..19: mol_type = other RNA
nagtaaaccagaccaacag

SEQ ID NO: 121 - RNA, 19 nt, synthetic construct
  source 1..19: mol_type = other RNA
nagtaaaccagaccaacan

SEQ ID NO: 122 - RNA, 19 nt, synthetic construct
  source 1..19: mol_type = other RNA
gcaattggtactcctcaac

SEQ ID NO: 123 - RNA, 19 nt, synthetic construct
  source 1..19: mol_type = other RNA
tcaattggtactcctcaac

SEQ ID NO: 124 - RNA, 19 nt, synthetic construct
  source 1..19: mol_type = other RNA
acaattggtactcctcaac

SEQ ID NO: 125 - RNA, 19 nt, synthetic construct
  source 1..19: mol_type = other RNA
ncaattggtactcctcaac

SEQ ID NO: 126 - RNA, 19 nt, synthetic construct
  source 1..19: mol_type = other RNA
ncaattggtactcctcaan

SEQ ID NO: 127 - RNA, 19 nt, synthetic construct
  source 1..19: mol_type = other RNA
cctctatcgagggatctga

SEQ ID NO: 128 - RNA, 19 nt, synthetic construct
  source 1..19: mol_type = other RNA
tctctatcgagggatctga

SEQ ID NO: 129 - RNA, 19 nt, synthetic construct
  source 1..19: mol_type = other RNA
actctatcgagggatctga

SEQ ID NO: 130 - RNA, 19 nt, synthetic construct
  source 1..19: mol_type = other RNA
nctctatcgagggatctga

SEQ ID NO: 131 - RNA, 19 nt, synthetic construct
  source 1..19: mol_type = other RNA
nctctatcgagggatctgn

SEQ ID NO: 132 - RNA, 19 nt, synthetic construct
  source 1..19: mol_type = other RNA
atttcctctatcgagggat

SEQ ID NO: 133 - RNA, 19 nt, synthetic construct
  source 1..19: mol_type = other RNA
ttttcctctatcgagggat

SEQ ID NO: 134 - RNA, 19 nt, synthetic construct
  source 1..19: mol_type = other RNA
ntttcctctatcgagggat

SEQ ID NO: 135 - RNA, 19 nt, synthetic construct
  source 1..19: mol_type = other RNA
ntttcctctatcgagggan

SEQ ID NO: 136 - RNA, 19 nt, synthetic construct
  source 1..19: mol_type = other RNA
ggatacttggtcgaaactt

SEQ ID NO: 137 - RNA, 19 nt, synthetic construct
  source 1..19: mol_type = other RNA
tgatacttggtcgaaactt

SEQ ID NO: 138 - RNA, 19 nt, synthetic construct
  source 1..19: mol_type = other RNA
agatacttggtcgaaactt

SEQ ID NO: 139 - RNA, 19 nt, synthetic construct
  source 1..19: mol_type = other RNA
ngatacttggtcgaaactt

SEQ ID NO: 140 - RNA, 19 nt, synthetic construct
  source 1..19: mol_type = other RNA
ngatacttggtcgaaactn

SEQ ID NO: 141 - RNA, 19 nt, synthetic construct
  source 1..19: mol_type = other RNA
tcttaatacgaagagcagt

SEQ ID NO: 142 - RNA, 19 nt, synthetic construct
  source 1..19: mol_type = other RNA
acttaatacgaagagcagt

SEQ ID NO: 143 - RNA, 19 nt, synthetic construct
  source 1..19: mol_type = other RNA
ncttaatacgaagagcagt

SEQ ID NO: 144 - RNA, 19 nt, synthetic construct
  source 1..19: mol_type = other RNA
ncttaatacgaagagcagn

SEQ ID NO: 145 - RNA, 19 nt, synthetic construct
  source 1..19: mol_type = other RNA
actgaagtgtgtatgtctt

SEQ ID NO: 146 - RNA, 19 nt, synthetic construct
  source 1..19: mol_type = other RNA
actgaagtgtgtatgtcta

SEQ ID NO: 147 - RNA, 19 nt, synthetic construct
  source 1..19: mol_type = other RNA
actgaagtgtgtatgtctn

SEQ ID NO: 148 - RNA, 19 nt, synthetic construct
  source 1..19: mol_type = other RNA
nctgaagtgtgtatgtctn

SEQ ID NO: 149 - RNA, 19 nt, synthetic construct
  source 1..19: mol_type = other RNA
aacagaaggagcatgttgg

SEQ ID NO: 150 - RNA, 19 nt, synthetic construct
  source 1..19: mol_type = other RNA
aacagaaggagcatgttga

SEQ ID NO: 151 - RNA, 19 nt, synthetic construct
  source 1..19: mol_type = other RNA
aacagaaggagcatgttgt

SEQ ID NO: 152 - RNA, 19 nt, synthetic construct
  source 1..19: mol_type = other RNA
aacagaaggagcatgttgn

SEQ ID NO: 153 - RNA, 19 nt, synthetic construct
  source 1..19: mol_type = other RNA
nacagaaggagcatgttgn

SEQ ID NO: 154 - RNA, 19 nt, synthetic construct
  source 1..19: mol_type = other RNA
gtcatgctaaccaatggaa

SEQ ID NO: 155 - RNA, 19 nt, synthetic construct
  source 1..19: mol_type = other RNA
gtcatgctaaccaatggat

SEQ ID NO: 156 - RNA, 19 nt, synthetic construct
  source 1..19: mol_type = other RNA
gtcatgctaaccaatggan

SEQ ID NO: 157 - RNA, 19 nt, synthetic construct
  source 1..19: mol_type = other RNA
ntcatgctaaccaatggan

SEQ ID NO: 158 - RNA, 19 nt, synthetic construct
  source 1..19: mol_type = other RNA
cttctgtcatagttccaac

SEQ ID NO: 159 - RNA, 19 nt, synthetic construct
  source 1..19: mol_type = other RNA
cttctgtcatagttccaaa

SEQ ID NO: 160 - RNA, 19 nt, synthetic construct
  source 1..19: mol_type = other RNA
cttctgtcatagttccaat

SEQ ID NO: 161 - RNA, 19 nt, synthetic construct
  source 1..19: mol_type = other RNA
cttctgtcatagttccaan

SEQ ID NO: 162 - RNA, 19 nt, synthetic construct
  source 1..19: mol_type = other RNA
nttctgtcatagttccaan

SEQ ID NO: 163 - RNA, 19 nt, synthetic construct
  source 1..19: mol_type = other RNA
ctgtcatagttccaacaat

SEQ ID NO: 164 - RNA, 19 nt, synthetic construct
  source 1..19: mol_type = other RNA
ctgtcatagttccaacaaa

SEQ ID NO: 165 - RNA, 19 nt, synthetic construct
  source 1..19: mol_type = other RNA
ctgtcatagttccaacaan

SEQ ID NO: 166 - RNA, 19 nt, synthetic construct
  source 1..19: mol_type = other RNA
ntgtcatagttccaacaan

SEQ ID NO: 167 - RNA, 19 nt, synthetic construct
  source 1..19: mol_type = other RNA
tggtatctgaatatcatga

SEQ ID NO: 168 - RNA, 19 nt, synthetic construct
  source 1..19: mol_type = other RNA
tggtatctgaatatcatgt

SEQ ID NO: 169 - RNA, 19 nt, synthetic construct
  source 1..19: mol_type = other RNA
tggtatctgaatatcatgn

SEQ ID NO: 170 - RNA, 19 nt, synthetic construct
  source 1..19: mol_type = other RNA
nggtatctgaatatcatgn

SEQ ID NO: 171 - RNA, 19 nt, synthetic construct
  source 1..19: mol_type = other RNA
aacagggctccttatatga

SEQ ID NO: 172 - RNA, 19 nt, synthetic construct
  source 1..19: mol_type = other RNA
aacagggctccttatatgt

SEQ ID NO: 173 - RNA, 19 nt, synthetic construct
  source 1..19: mol_type = other RNA
aacagggctccttatatgn

SEQ ID NO: 174 - RNA, 19 nt, synthetic construct
  source 1..19: mol_type = other RNA
nacagggctccttatatgn

SEQ ID NO: 175 - RNA, 19 nt, synthetic construct
  source 1..19: mol_type = other RNA
gtctggcacaccttcatat

SEQ ID NO: 176 - RNA, 19 nt, synthetic construct
  source 1..19: mol_type = other RNA
gtctggcacaccttcataa

SEQ ID NO: 177 - RNA, 19 nt, synthetic construct
  source 1..19: mol_type = other RNA
gtctggcacaccttcatan

SEQ ID NO: 178 - RNA, 19 nt, synthetic construct
  source 1..19: mol_type = other RNA
ntctggcacaccttcatan

SEQ ID NO: 179 - RNA, 19 nt, synthetic construct
  source 1..19: mol_type = other RNA
ctggcacaccttcatatgg

SEQ ID NO: 180 - RNA, 19 nt, synthetic construct
  source 1..19: mol_type = other RNA
ctggcacaccttcatatga

SEQ ID NO: 181 - RNA, 19 nt, synthetic construct
  source 1..19: mol_type = other RNA
ctggcacaccttcatatgt

SEQ ID NO: 182 - RNA, 19 nt, synthetic construct
  source 1..19: mol_type = other RNA
ctggcacaccttcatatgn

SEQ ID NO: 183 - RNA, 19 nt, synthetic construct
  source 1..19: mol_type = other RNA
ntggcacaccttcatatgn

SEQ ID NO: 184 - RNA, 19 nt, synthetic construct
  source 1..19: mol_type = other RNA
ggcacaccttcatatggag

SEQ ID NO: 185 - RNA, 19 nt, synthetic construct
  source 1..19: mol_type = other RNA
ggcacaccttcatatggaa

SEQ ID NO: 186 - RNA, 19 nt, synthetic construct
  source 1..19: mol_type = other RNA
ggcacaccttcatatggat

SEQ ID NO: 187 - RNA, 19 nt, synthetic construct
  source 1..19: mol_type = other RNA
ggcacaccttcatatggan

SEQ ID NO: 188 - RNA, 19 nt, synthetic construct
  source 1..19: mol_type = other RNA
ngcacaccttcatatggan

SEQ ID NO: 189 - RNA, 19 nt, synthetic construct
  source 1..19: mol_type = other RNA
acaaggtaaacctgctatt

SEQ ID NO: 190 - RNA, 19 nt, synthetic construct
  source 1..19: mol_type = other RNA
acaaggtaaacctgctata

SEQ ID NO: 191 - RNA, 19 nt, synthetic construct
  source 1..19: mol_type = other RNA
acaaggtaaacctgctatn

SEQ ID NO: 192 - RNA, 19 nt, synthetic construct
  source 1..19: mol_type = other RNA
ncaaggtaaacctgctatn

SEQ ID NO: 193 - RNA, 19 nt, synthetic construct
  source 1..19: mol_type = other RNA
aggtaaacctgctattgct

SEQ ID NO: 194 - RNA, 19 nt, synthetic construct
  source 1..19: mol_type = other RNA
aggtaaacctgctattgca

SEQ ID NO: 195 - RNA, 19 nt, synthetic construct
  source 1..19: mol_type = other RNA
aggtaaacctgctattgcn

SEQ ID NO: 196 - RNA, 19 nt, synthetic construct
  source 1..19: mol_type = other RNA
nggtaaacctgctattgcn

SEQ ID NO: 197 - RNA, 19 nt, synthetic construct
  source 1..19: mol_type = other RNA
gtgccatagcggacttagg

SEQ ID NO: 198 - RNA, 19 nt, synthetic construct
  source 1..19: mol_type = other RNA
gtgccatagcggacttaga

SEQ ID NO: 199 - RNA, 19 nt, synthetic construct
  source 1..19: mol_type = other RNA
gtgccatagcggacttagt

SEQ ID NO: 200 - RNA, 19 nt, synthetic construct
  source 1..19: mol_type = other RNA
gtgccatagcggacttagn

SEQ ID NO: 201 - RNA, 19 nt, synthetic construct
  source 1..19: mol_type = other RNA
ntgccatagcggacttagn

SEQ ID NO: 202 - RNA, 19 nt, synthetic construct
  source 1..19: mol_type = other RNA
ctgtgaagcatgattcaat

SEQ ID NO: 203 - RNA, 19 nt, synthetic construct
  source 1..19: mol_type = other RNA
ctgtgaagcatgattcaaa

SEQ ID NO: 204 - RNA, 19 nt, synthetic construct
  source 1..19: mol_type = other RNA
ctgtgaagcatgattcaan

SEQ ID NO: 205 - RNA, 19 nt, synthetic construct
  source 1..19: mol_type = other RNA
ntgtgaagcatgattcaan

SEQ ID NO: 206 - RNA, 19 nt, synthetic construct
  source 1..19: mol_type = other RNA
tgtgaagcatgattcaata

SEQ ID NO: 207 - RNA, 19 nt, synthetic construct
  source 1..19: mol_type = other RNA
tgtgaagcatgattcaatt

SEQ ID NO: 208 - RNA, 19 nt, synthetic construct
  source 1..19: mol_type = other RNA
tgtgaagcatgattcaatn

SEQ ID NO: 209 - RNA, 19 nt, synthetic construct
  source 1..19: mol_type = other RNA
ngtgaagcatgattcaatn

SEQ ID NO: 210 - RNA, 19 nt, synthetic construct
  source 1..19: mol_type = other RNA
aatactgaacactatcgac

SEQ ID NO: 211 - RNA, 19 nt, synthetic construct
  source 1..19: mol_type = other RNA
aatactgaacactatcgaa

SEQ ID NO: 212 - RNA, 19 nt, synthetic construct
  source 1..19: mol_type = other RNA
aatactgaacactatcgat

SEQ ID NO: 213 - RNA, 19 nt, synthetic construct
  source 1..19: mol_type = other RNA
aatactgaacactatcgan

SEQ ID NO: 214 - RNA, 19 nt, synthetic construct
  source 1..19: mol_type = other RNA
natactgaacactatcgan

SEQ ID NO: 215 - RNA, 19 nt, synthetic construct
  source 1..19: mol_type = other RNA
tcgacatacctcagaatcc

SEQ ID NO: 216 - RNA, 19 nt, synthetic construct
  source 1..19: mol_type = other RNA
tcgacatacctcagaatca

SEQ ID NO: 217 - RNA, 19 nt, synthetic construct
  source 1..19: mol_type = other RNA
tcgacatacctcagaatct

SEQ ID NO: 218 - RNA, 19 nt, synthetic construct
  source 1..19: mol_type = other RNA
tcgacatacctcagaatcn

SEQ ID NO: 219 - RNA, 19 nt, synthetic construct
  source 1..19: mol_type = other RNA
ncgacatacctcagaatcn

SEQ ID NO: 220 - RNA, 19 nt, synthetic construct
  source 1..19: mol_type = other RNA
tgaaatgcttgatgataca

SEQ ID NO: 221 - RNA, 19 nt, synthetic construct
  source 1..19: mol_type = other RNA
tgaaatgcttgatgatact

SEQ ID NO: 222 - RNA, 19 nt, synthetic construct
  source 1..19: mol_type = other RNA
tgaaatgcttgatgatacn

SEQ ID NO: 223 - RNA, 19 nt, synthetic construct
  source 1..19: mol_type = other RNA
ngaaatgcttgatgatacn

SEQ ID NO: 224 - RNA, 19 nt, synthetic construct
  source 1..19: mol_type = other RNA
aatgcttgatgatacaatg

SEQ ID NO: 225 - RNA, 19 nt, synthetic construct
  source 1..19: mol_type = other RNA
aatgcttgatgatacaata

SEQ ID NO: 226 - RNA, 19 nt, synthetic construct
  source 1..19: mol_type = other RNA
aatgcttgatgatacaatt

SEQ ID NO: 227 - RNA, 19 nt, synthetic construct
  source 1..19: mol_type = other RNA
aatgcttgatgatacaatn

SEQ ID NO: 228 - RNA, 19 nt, synthetic construct
  source 1..19: mol_type = other RNA
natgcttgatgatacaatn

SEQ ID NO: 229 - RNA, 19 nt, synthetic construct
  source 1..19: mol_type = other RNA
cgagctgacatctattctg

SEQ ID NO: 230 - RNA, 19 nt, synthetic construct
  source 1..19: mol_type = other RNA
cgagctgacatctattcta

SEQ ID NO: 231 - RNA, 19 nt, synthetic construct
  source 1..19: mol_type = other RNA
cgagctgacatctattctt

SEQ ID NO: 232 - RNA, 19 nt, synthetic construct
  source 1..19: mol_type = other RNA
cgagctgacatctattctn

SEQ ID NO: 233 - RNA, 19 nt, synthetic construct
  source 1..19: mol_type = other RNA
ngagctgacatctattctn

SEQ ID NO: 234 - RNA, 19 nt, synthetic construct
  source 1..19: mol_type = other RNA
ctgttggtctggtttactg

SEQ ID NO: 235 - RNA, 19 nt, synthetic construct
  source 1..19: mol_type = other RNA
ctgttggtctggtttacta

SEQ ID NO: 236 - RNA, 19 nt, synthetic construct
  source 1..19: mol_type = other RNA
ctgttggtctggtttactt

SEQ ID NO: 237 - RNA, 19 nt, synthetic construct
  source 1..19: mol_type = other RNA
ctgttggtctggtttactn

SEQ ID NO: 238 - RNA, 19 nt, synthetic construct
  source 1..19: mol_type = other RNA
ntgttggtctggtttactn

SEQ ID NO: 239 - RNA, 19 nt, synthetic construct
  source 1..19: mol_type = other RNA
gttgaggagtaccaattgc

SEQ ID NO: 240 - RNA, 19 nt, synthetic construct
  source 1..19: mol_type = other RNA
gttgaggagtaccaattga

SEQ ID NO: 241 - RNA, 19 nt, synthetic construct
  source 1..19: mol_type = other RNA
gttgaggagtaccaattgt

SEQ ID NO: 242 - RNA, 19 nt, synthetic construct
  source 1..19: mol_type = other RNA
gttgaggagtaccaattgn

SEQ ID NO: 243 - RNA, 19 nt, synthetic construct
  source 1..19: mol_type = other RNA
nttgaggagtaccaattgn

SEQ ID NO: 244 - RNA, 19 nt, synthetic construct
  source 1..19: mol_type = other RNA
tcagatccctcgatagagg

SEQ ID NO: 245 - RNA, 19 nt, synthetic construct
  source 1..19: mol_type = other RNA
tcagatccctcgatagaga

SEQ ID NO: 246 - RNA, 19 nt, synthetic construct
  source 1..19: mol_type = other RNA
tcagatccctcgatagagt

SEQ ID NO: 247 - RNA, 19 nt, synthetic construct
  source 1..19: mol_type = other RNA
tcagatccctcgatagagn

SEQ ID NO: 248 - RNA, 19 nt, synthetic construct
  source 1..19: mol_type = other RNA
ncagatccctcgatagagn

SEQ ID NO: 249 - RNA, 19 nt, synthetic construct
  source 1..19: mol_type = other RNA
atccctcgatagaggaaat

SEQ ID NO: 250 - RNA, 19 nt, synthetic construct
  source 1..19: mol_type = other RNA
atccctcgatagaggaaaa

SEQ ID NO: 251 - RNA, 19 nt, synthetic construct
  source 1..19: mol_type = other RNA
atccctcgatagaggaaan

SEQ ID NO: 252 - RNA, 19 nt, synthetic construct
  source 1..19: mol_type = other RNA
ntccctcgatagaggaaan

SEQ ID NO: 253 - RNA, 19 nt, synthetic construct
  source 1..19: mol_type = other RNA
aagtttcgaccaagtatcc

SEQ ID NO: 254 - RNA, 19 nt, synthetic construct
  source 1..19: mol_type = other RNA
aagtttcgaccaagtatca

SEQ ID NO: 255 - RNA, 19 nt, synthetic construct
  source 1..19: mol_type = other RNA
aagtttcgaccaagtatct

SEQ ID NO: 256 - RNA, 19 nt, synthetic construct
  source 1..19: mol_type = other RNA
aagtttcgaccaagtatcn

SEQ ID NO: 257 - RNA, 19 nt, synthetic construct
  source 1..19: mol_type = other RNA
nagtttcgaccaagtatcn

SEQ ID NO: 258 - RNA, 19 nt, synthetic construct
  source 1..19: mol_type = other RNA
actgctcttcgtattaaga

SEQ ID NO: 259 - RNA, 19 nt, synthetic construct
  source 1..19: mol_type = other RNA
actgctcttcgtattaagt

SEQ ID NO: 260 - RNA, 19 nt, synthetic construct
  source 1..19: mol_type = other RNA
actgctcttcgtattaagn

SEQ ID NO: 261 - RNA, 19 nt, synthetic construct
  source 1..19: mol_type = other RNA
nctgctcttcgtattaagn

SEQ ID NO: 262 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = gm
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = gm
  modified_base 14: mod_base = OTHER; note = 2'-fluorouridine
  modified_base 15: mod_base = gm
  modified_base 16: mod_base = OTHER; note = 2'-fluorocytidine
  modified_base 17: mod_base = um
  modified_base 18: mod_base = um
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tatgatagaatcgtgcttcac

SEQ ID NO: 263 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = gm
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluorouridine
  modified_base 17: mod_base = gm
  modified_base 18: mod_base = um
  modified_base 19: mod_base = cm
  modified_base 20: mod_base = um
  modified_base 20^21: mod_base = OTHER; note = phosphorothioate linkage
  modified_base 21: mod_base = cm
  source 1..21: mol_type = other RNA
taggattctggggtatgtctc

SEQ ID NO: 264 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = um
  modified_base 18: mod_base = cm
  modified_base 19: mod_base = gm
  modified_base 20: mod_base = cm
  modified_base 20^21: mod_base = OTHER; note = phosphorothioate linkage
  modified_base 21: mod_base = um
  source 1..21: mol_type = other RNA
tcgaatagatgtcagctcgct

SEQ ID NO: 265 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = OTHER; note = 2'-fluorouridine
  modified_base 8: mod_base = OTHER; note = 2'-O-methyladenosine
  modified_base 9: mod_base = cm
  modified_base 10: mod_base = OTHER; note = 2'-O-methyladenosine
  modified_base 11: mod_base = cm
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
aagacatacacacttcagtcc

SEQ ID NO: 266 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = OTHER; note = 2'-fluorouridine
  modified_base 8: mod_base = gm
  modified_base 9: mod_base = cm
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = gm
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = gm
  source 1..21: mol_type = other RNA
tcaacatgctccttctgtttg

SEQ ID NO: 267 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = gm
  modified_base 9: mod_base = gm
  modified_base 10: mod_base = um
  modified_base 11: mod_base = um
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = gm
  modified_base 18: mod_base = OTHER; note = 2'-O-methyladenosine
  modified_base 19: mod_base = cm
  modified_base 20: mod_base = um
  modified_base 20^21: mod_base = OTHER; note = phosphorothioate linkage
  modified_base 21: mod_base = gm
  source 1..21: mol_type = other RNA
ttccattggttagcatgactg

SEQ ID NO: 268 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgacagaagac

SEQ ID NO: 269 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = um
  modified_base 6: mod_base = um
  modified_base 7: mod_base = OTHER; note = 2'-fluoroguanosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
attgttggaactatgacagac

SEQ ID NO: 270 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 271 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = gm
  modified_base 10: mod_base = gm
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = gm
  modified_base 18: mod_base = um
  modified_base 19: mod_base = um
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
tcatataaggagccctgttca

SEQ ID NO: 272 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = gm
  modified_base 10: mod_base = um
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluoroadenosine
  modified_base 17: mod_base = gm
  modified_base 18: mod_base = OTHER; note = 2'-O-methyladenosine
  modified_base 19: mod_base = cm
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
atatgaaggtgtgccagacca

SEQ ID NO: 273 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = gm
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorouridine
  modified_base 15: mod_base = gm
  modified_base 16: mod_base = OTHER; note = 2'-fluorocytidine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tcatatgaaggtgtgccagac

SEQ ID NO: 274 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = cm
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = um
  modified_base 9: mod_base = gm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
ttccatatgaaggtgtgccag

SEQ ID NO: 275 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = gm
  modified_base 6: mod_base = cm
  modified_base 7: mod_base = OTHER; note = 2'-fluoroadenosine
  modified_base 8: mod_base = gm
  modified_base 9: mod_base = gm
  modified_base 10: mod_base = um
  modified_base 11: mod_base = um
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = um
  modified_base 18: mod_base = gm
  modified_base 19: mod_base = um
  modified_base 20: mod_base = gm
  modified_base 20^21: mod_base = OTHER; note = phosphorothioate linkage
  modified_base 21: mod_base = um
  source 1..21: mol_type = other RNA
aatagcaggtttaccttgtgt

SEQ ID NO: 276 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = gm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluorouridine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = um
  modified_base 20: mod_base = um
  modified_base 20^21: mod_base = OTHER; note = phosphorothioate linkage
  modified_base 21: mod_base = gm
  source 1..21: mol_type = other RNA
agcaatagcaggtttaccttg

SEQ ID NO: 277 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = OTHER; note = 2'-fluorouridine
  modified_base 8: mod_base = cm
  modified_base 9: mod_base = cm
  modified_base 10: mod_base = gm
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroguanosine
  modified_base 17: mod_base = cm
  modified_base 18: mod_base = OTHER; note = 2'-O-methyladenosine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = OTHER; note = 2'-O-methyladenosine
  source 1..21: mol_type = other RNA
tctaagtccgctatggcacaa

SEQ ID NO: 278 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = cm
  modified_base 20^21: mod_base = OTHER; note = phosphorothioate linkage
  modified_base 21: mod_base = cm
  source 1..21: mol_type = other RNA
attgaatcatgcttcacagcc

SEQ ID NO: 279 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tattgaatcatgcttcacagc

SEQ ID NO: 280 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = gm
  modified_base 9: mod_base = um
  modified_base 10: mod_base = gm
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 281 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = um
  modified_base 6: mod_base = cm
  modified_base 7: mod_base = OTHER; note = 2'-fluorouridine
  modified_base 8: mod_base = gm
  modified_base 9: mod_base = OTHER; note = 2'-O-methyladenosine
  modified_base 10: mod_base = gm
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = gm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tgattctgaggtatgtcgatc

SEQ ID NO: 282 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = OTHER; note = 2'-fluoroadenosine
  modified_base 8: mod_base = um
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 283 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = gm
  modified_base 6: mod_base = um
  modified_base 7: mod_base = OTHER; note = 2'-fluoroadenosine
  modified_base 8: mod_base = um
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tattgtatcatcaagcatttc

SEQ ID NO: 284 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = um
  modified_base 18: mod_base = cm
  modified_base 19: mod_base = gm
  modified_base 20: mod_base = um
  modified_base 20^21: mod_base = OTHER; note = phosphorothioate linkage
  modified_base 21: mod_base = um
  source 1..21: mol_type = other RNA
tagaatagatgtcagctcgtt

SEQ ID NO: 285 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tagtaaaccagaccaacagac

SEQ ID NO: 286 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = um
  modified_base 7: mod_base = OTHER; note = 2'-fluoroguanosine
  modified_base 8: mod_base = gm
  modified_base 9: mod_base = um
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tcaattggtactcctcaacac

SEQ ID NO: 287 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 4: mod_base = cm
  modified_base 5: mod_base = um
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = gm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = um
  modified_base 18: mod_base = gm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tctctatcgagggatctgaag

SEQ ID NO: 288 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = um
  modified_base 5: mod_base = cm
  modified_base 6: mod_base = cm
  modified_base 7: mod_base = OTHER; note = 2'-fluorouridine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = gm
  modified_base 18: mod_base = OTHER; note = 2'-O-methyladenosine
  modified_base 19: mod_base = um
  modified_base 20: mod_base = cm
  modified_base 20^21: mod_base = OTHER; note = phosphorothioate linkage
  modified_base 21: mod_base = um
  source 1..21: mol_type = other RNA
atttcctctatcgagggatct

SEQ ID NO: 289 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = cm
  modified_base 7: mod_base = OTHER; note = 2'-fluorouridine
  modified_base 8: mod_base = um
  modified_base 9: mod_base = gm
  modified_base 10: mod_base = gm
  modified_base 11: mod_base = um
  modified_base 12: mod_base = OTHER; note = 2'-fluorocytidine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = um
  modified_base 19: mod_base = um
  modified_base 20: mod_base = cm
  modified_base 20^21: mod_base = OTHER; note = phosphorothioate linkage
  modified_base 21: mod_base = um
  source 1..21: mol_type = other RNA
tgatacttggtcgaaacttct

SEQ ID NO: 290 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluorouridine
  modified_base 8: mod_base = OTHER; note = 2'-O-methyladenosine
  modified_base 9: mod_base = cm
  modified_base 10: mod_base = gm
  modified_base 11: mod_base = OTHER; note = 2'-O-methyladenosine
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = gm
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tcttaatacgaagagcagttc

SEQ ID NO: 291 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = gm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = gm
  modified_base 14: mod_base = OTHER; note = 2'-fluorouridine
  modified_base 15: mod_base = gm
  modified_base 16: mod_base = OTHER; note = 2'-fluorocytidine
  modified_base 17: mod_base = um
  modified_base 18: mod_base = um
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tatgatagaatcgtgcttcac

SEQ ID NO: 292 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgacagaagac

SEQ ID NO: 293 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgacagaagac

SEQ ID NO: 294 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-fluorouridine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgacagaagac

SEQ ID NO: 295 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = OTHER; note = 2'-fluoroguanosine
  modified_base 5: mod_base = gm
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgacagaagac

SEQ ID NO: 296 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-fluoroadenosine
  modified_base 7: mod_base = OTHER; note = 2'-O-methyladenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgacagaagac

SEQ ID NO: 297 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-fluorocytidine
  modified_base 9: mod_base = um
  modified_base 10: mod_base = OTHER; note = 2'-fluoroadenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgacagaagac

SEQ ID NO: 298 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = um
  modified_base 6: mod_base = um
  modified_base 7: mod_base = OTHER; note = 2'-fluoroguanosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 19^20: mod_base = OTHER; note = phosphorothioate linkage
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
attgttggaactatgacagac

SEQ ID NO: 299 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = um
  modified_base 6: mod_base = um
  modified_base 7: mod_base = OTHER; note = 2'-fluoroguanosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttgttggaactatgacagac

SEQ ID NO: 300 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = um
  modified_base 6: mod_base = um
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
attgttggaactatgacagac

SEQ ID NO: 301 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-fluorouridine
  modified_base 4: mod_base = gm
  modified_base 5: mod_base = um
  modified_base 6: mod_base = um
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
attgttggaactatgacagac

SEQ ID NO: 302 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = OTHER; note = 2'-fluoroguanosine
  modified_base 5: mod_base = um
  modified_base 6: mod_base = um
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
attgttggaactatgacagac

SEQ ID NO: 303 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = um
  modified_base 6: mod_base = OTHER; note = 2'-fluorouridine
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
attgttggaactatgacagac

SEQ ID NO: 304 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 305 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-O-methyladenosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 306 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-fluoroadenosine
  modified_base 4: mod_base = um
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 307 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-fluorouridine
  modified_base 5: mod_base = gm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 308 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-fluoroadenosine
  modified_base 7: mod_base = um
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 309 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-fluoroadenosine
  modified_base 7: mod_base = um
  modified_base 8: mod_base = OTHER; note = 2'-fluoroadenosine
  modified_base 9: mod_base = um
  modified_base 10: mod_base = OTHER; note = 2'-fluorouridine
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 310 - RNA, 21 nt, synthetic construct
  modified_base 1: mod_base = OTHER; note = 5'-cyclopropyl phosphonate-2'-O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = um
  modified_base 6: mod_base = um
  modified_base 7: mod_base = OTHER; note = 2'-fluoroguanosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
nttgttggaactatgacagac

SEQ ID NO: 311 - RNA, 21 nt, synthetic construct
  modified_base 1: mod_base = OTHER; note = 5'-cyclopropyl phosphonate-2'-O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = um
  modified_base 6: mod_base = um
  modified_base 7: mod_base = OTHER; note = 2'-fluoroguanosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
nttgttggaactatgacagac

SEQ ID NO: 312 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = gm
  modified_base 9: mod_base = um
  modified_base 10: mod_base = gm
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 313 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = gm
  modified_base 9: mod_base = um
  modified_base 10: mod_base = gm
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = um
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 314 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-fluorocytidine
  modified_base 4: mod_base = gm
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = gm
  modified_base 9: mod_base = um
  modified_base 10: mod_base = gm
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 315 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = OTHER; note = 2'-fluoroguanosine
  modified_base 5: mod_base = OTHER; note = 2'-O-methyladenosine
  modified_base 6: mod_base = um
  modified_base 7: mod_base = OTHER; note = 2'-O-methyladenosine
  modified_base 8: mod_base = gm
  modified_base 9: mod_base = um
  modified_base 10: mod_base = gm
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 316 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = gm
  modified_base 9: mod_base = um
  modified_base 10: mod_base = gm
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 317 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluoroguanosine
  modified_base 9: mod_base = um
  modified_base 10: mod_base = OTHER; note = 2'-fluoroguanosine
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 318 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluoroguanosine
  modified_base 9: mod_base = um
  modified_base 10: mod_base = OTHER; note = 2'-fluoroguanosine
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 319 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = OTHER; note = 2'-fluoroadenosine
  modified_base 8: mod_base = um
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 320 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = um
  modified_base 6: mod_base = cm
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 321 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-fluorouridine
  modified_base 4: mod_base = OTHER; note = 2'-O-methyladenosine
  modified_base 5: mod_base = um
  modified_base 6: mod_base = cm
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 322 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-fluoroadenosine
  modified_base 5: mod_base = um
  modified_base 6: mod_base = cm
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 323 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 324 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 325 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-fluoroadenosine
  modified_base 5: mod_base = um
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 326 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = gm
  modified_base 6: mod_base = um
  modified_base 7: mod_base = OTHER; note = 2'-fluoroadenosine
  modified_base 8: mod_base = um
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 19^20: mod_base = OTHER; note = phosphorothioate linkage
  modified_base 20: mod_base = um
  modified_base 20^21: mod_base = OTHER; note = phosphorothioate linkage
  modified_base 21: mod_base = cm
  source 1..21: mol_type = other RNA
tattgtatcatcaagcatttc

SEQ ID NO: 327 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tattgtatcatcaagcatttc

SEQ ID NO: 328 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-fluorouridine
  modified_base 4: mod_base = um
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tattgtatcatcaagcatttc

SEQ ID NO: 329 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = OTHER; note = 2'-fluorouridine
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tattgtatcatcaagcatttc

SEQ ID NO: 330 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = gm
  modified_base 6: mod_base = OTHER; note = 2'-fluorouridine
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tattgtatcatcaagcatttc

SEQ ID NO: 331 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = gm
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tattgtatcatcaagcatttc

SEQ ID NO: 332 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = OTHER; note = 2'-fluorouridine
  modified_base 5: mod_base = gm
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = cm
  source 1..21: mol_type = other RNA
tattgtatcatcaagcatttc

SEQ ID NO: 333 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = OTHER; note = 2'-fluorouridine
  modified_base 6: mod_base = cm
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 334 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = OTHER; note = 2'-O-methyladenosine
  modified_base 5: mod_base = OTHER; note = 2'-fluorouridine
  modified_base 6: mod_base = cm
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = gm
  source 1..21: mol_type = other RNA
tgtatcatcaagcatttcagg

SEQ ID NO: 335 - RNA, 21 nt, synthetic construct
  modified_base 1: mod_base = OTHER; note = 5'-cyclopropyl phosphonate-2'-O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = OTHER; note = 2'-fluorouridine
  modified_base 6: mod_base = um
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
nttgttggaactatgacagac

SEQ ID NO: 336 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = OTHER; note = 2'-fluoroguanosine
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 337 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = OTHER; note = 2'-fluoroguanosine
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroadenosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
tcatgatattcagataccagc

SEQ ID NO: 338 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = OTHER; note = 2'-fluoroadenosine
  modified_base 6: mod_base = um
  modified_base 7: mod_base = OTHER; note = 2'-O-methyladenosine
  modified_base 8: mod_base = gm
  modified_base 9: mod_base = um
  modified_base 10: mod_base = gm
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 339 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = OTHER; note = 2'-fluoroadenosine
  modified_base 6: mod_base = um
  modified_base 7: mod_base = OTHER; note = 2'-O-methyladenosine
  modified_base 8: mod_base = gm
  modified_base 9: mod_base = um
  modified_base 10: mod_base = gm
  modified_base 11: mod_base = um
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = um
  modified_base 19: mod_base = um
  modified_base 20: mod_base = gm
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
ttcgatagtgttcagtattgc

SEQ ID NO: 340 - RNA, 21 nt, synthetic construct
  modified_base 1: mod_base = OTHER; note = 5'-cyclopropyl phosphonate-2'-O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = OTHER; note = 2'-fluorouridine
  modified_base 6: mod_base = um
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
nttgttggaactatgacagac

SEQ ID NO: 341 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgatagaagac

SEQ ID NO: 342 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = gm
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgacagaggac

SEQ ID NO: 343 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = gm
  modified_base 20^21: mod_base = OTHER; note = phosphorothioate linkage
  modified_base 21: mod_base = cm
  source 1..21: mol_type = other RNA
tttggaactatgacagaaggc

SEQ ID NO: 344 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = gm
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggaactatgatagaggac

SEQ ID NO: 345 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = gm
  modified_base 20^21: mod_base = OTHER; note = phosphorothioate linkage
  modified_base 21: mod_base = cm
  source 1..21: mol_type = other RNA
tttggaactatgatagaaggc

SEQ ID NO: 346 - RNA, 19 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = gm
  modified_base 18: mod_base = gm
  modified_base 19: mod_base = gm
  source 1..19: mol_type = other RNA
tttggaactatgacagggg

SEQ ID NO: 347 - RNA, 19 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = gm
  modified_base 18: mod_base = gm
  modified_base 19: mod_base = gm
  source 1..19: mol_type = other RNA
tttggaactatgatagggg

SEQ ID NO: 348 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = OTHER; note = 2'-fluoroguanosine
  modified_base 5: mod_base = um
  modified_base 6: mod_base = um
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttgttggaactatgacagac

SEQ ID NO: 349 - RNA, 21 nt, synthetic construct
  modified_base 1: mod_base = OTHER; note = 5'-cyclopropyl phosphonate-2'-O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = OTHER; note = 2'-fluoroguanosine
  modified_base 5: mod_base = um
  modified_base 6: mod_base = um
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
nttgttggaactatgacagac

SEQ ID NO: 350 - RNA, 21 nt, synthetic construct
  modified_base 1: mod_base = OTHER; note = 5'-cyclopropyl phosphonate-2'-O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = OTHER; note = 2'-fluoroguanosine
  modified_base 5: mod_base = um
  modified_base 6: mod_base = um
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
nttgttggaactatgacagac

SEQ ID NO: 351 - RNA, 21 nt, synthetic construct
  modified_base 1: mod_base = OTHER; note = 5'-cyclopropyl phosphonate-2'-O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = um
  modified_base 6: mod_base = um
  modified_base 7: mod_base = OTHER; note = 2'-fluoroguanosine
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
nttgttggaactatgacagac

SEQ ID NO: 352 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
tttggaactatgacagaagac

SEQ ID NO: 353 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = gm
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttgggactatgacagaagac

SEQ ID NO: 354 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2',3'-seco-guanosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttgggactatgacagaagac

SEQ ID NO: 355 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2',3'-seco-guanosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = gm
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttgggactatgacagaggac

SEQ ID NO: 356 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroguanosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggagctatgacagaagac

SEQ ID NO: 357 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2',3'-seco-guanosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = gm
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttggagctatgacagaggac

SEQ ID NO: 358 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = OTHER; note = 2'-O-methylinosine
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttngaactatgacagaagac

SEQ ID NO: 359 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = OTHER; note = 2'-O-methylinosine
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
tttgnaactatgacagaagac

SEQ ID NO: 360 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = um
  source 1..21: mol_type = other RNA
ggactgaagtgtgtatgtctt

SEQ ID NO: 361 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
caaacagaaggagcatgttga

SEQ ID NO: 362 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = um
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
cagtcatgctaaccaatggaa

SEQ ID NO: 363 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 364 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 365 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 366 - RNA, 21 nt, synthetic construct
  modified_base 1: mod_base = um
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = cm
  modified_base 13: mod_base = cm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
tgaacagggctccttatatga

SEQ ID NO: 367 - RNA, 21 nt, synthetic construct
  modified_base 1: mod_base = um
  modified_base 2: mod_base = gm
  modified_base 3: mod_base = gm
  modified_base 4: mod_base = um
  modified_base 5: mod_base = cm
  modified_base 6: mod_base = um
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = um
  source 1..21: mol_type = other RNA
tggtctggcacaccttcatat

SEQ ID NO: 368 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = gm
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gtctggcacaccttcatatga

SEQ ID NO: 369 - RNA, 21 nt, synthetic construct
  modified_base 1: mod_base = cm
  modified_base 2: mod_base = um
  modified_base 3: mod_base = gm
  modified_base 4: mod_base = gm
  modified_base 5: mod_base = cm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
ctggcacaccttcatatggaa

SEQ ID NO: 370 - RNA, 21 nt, synthetic construct
  modified_base 1: mod_base = OTHER; note = 2'-O-methyladenosine
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = cm
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
acacaaggtaaacctgctatt

SEQ ID NO: 371 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = cm
  modified_base 21: mod_base = um
  source 1..21: mol_type = other RNA
caaggtaaacctgctattgct

SEQ ID NO: 372 - RNA, 21 nt, synthetic construct
  modified_base 1: mod_base = um
  modified_base 2: mod_base = um
  modified_base 3: mod_base = gm
  modified_base 4: mod_base = um
  modified_base 5: mod_base = gm
  modified_base 6: mod_base = cm
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
ttgtgccatagcggacttaga

SEQ ID NO: 373 - RNA, 21 nt, synthetic construct
  modified_base 1: mod_base = gm
  modified_base 2: mod_base = gm
  modified_base 3: mod_base = cm
  modified_base 4: mod_base = um
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
ggctgtgaagcatgattcaat

SEQ ID NO: 374 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
gctgtgaagcatgattcaata

SEQ ID NO: 375 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 376 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = cm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gatcgacatacctcagaatca

SEQ ID NO: 377 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 378 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 379 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = gm
  modified_base 5: mod_base = OTHER; note = 2'-O-methyladenosine
  modified_base 6: mod_base = gm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
aacgagctgacatctattcta

SEQ ID NO: 380 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
gtctgttggtctggtttacta

SEQ ID NO: 381 - RNA, 21 nt, synthetic construct
  modified_base 1: mod_base = gm
  modified_base 2: mod_base = um
  modified_base 3: mod_base = gm
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
gtgttgaggagtaccaattga

SEQ ID NO: 382 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = gm
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
cttcagatccctcgatagaga

SEQ ID NO: 383 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = um
  modified_base 5: mod_base = cm
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = gm
  modified_base 17: mod_base = gm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
agatccctcgatagaggaaat

SEQ ID NO: 384 - RNA, 21 nt, synthetic construct
  modified_base 1: mod_base = OTHER; note = 2'-O-methyl-2-aminoadenosine
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = um
  modified_base 8: mod_base = um
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
ngaagtttcgaccaagtatca

SEQ ID NO: 385 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
gaactgctcttcgtattaaga

SEQ ID NO: 386 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = um
  source 1..21: mol_type = other RNA
ggactgaagtgtgtatgtctt

SEQ ID NO: 387 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
caaacagaaggagcatgttga

SEQ ID NO: 388 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = um
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
cagtcatgctaaccaatggaa

SEQ ID NO: 389 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 390 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 391 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 392 - RNA, 21 nt, synthetic construct
  modified_base 1: mod_base = um
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = cm
  modified_base 13: mod_base = cm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
tgaacagggctccttatatga

SEQ ID NO: 393 - RNA, 21 nt, synthetic construct
  modified_base 1: mod_base = um
  modified_base 2: mod_base = gm
  modified_base 3: mod_base = gm
  modified_base 4: mod_base = um
  modified_base 5: mod_base = cm
  modified_base 6: mod_base = um
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = um
  source 1..21: mol_type = other RNA
tggtctggcacaccttcatat

SEQ ID NO: 394 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = gm
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gtctggcacaccttcatatga

SEQ ID NO: 395 - RNA, 21 nt, synthetic construct
  modified_base 1: mod_base = cm
  modified_base 2: mod_base = um
  modified_base 3: mod_base = gm
  modified_base 4: mod_base = gm
  modified_base 5: mod_base = cm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
ctggcacaccttcatatggaa

SEQ ID NO: 396 - RNA, 21 nt, synthetic construct
  modified_base 1: mod_base = OTHER; note = 2'-O-methyladenosine
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = cm
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
acacaaggtaaacctgctatt

SEQ ID NO: 397 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = cm
  modified_base 21: mod_base = um
  source 1..21: mol_type = other RNA
caaggtaaacctgctattgct

SEQ ID NO: 398 - RNA, 21 nt, synthetic construct
  modified_base 1: mod_base = um
  modified_base 2: mod_base = um
  modified_base 3: mod_base = gm
  modified_base 4: mod_base = um
  modified_base 5: mod_base = gm
  modified_base 6: mod_base = cm
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
ttgtgccatagcggacttaga

SEQ ID NO: 399 - RNA, 21 nt, synthetic construct
  modified_base 1: mod_base = gm
  modified_base 2: mod_base = gm
  modified_base 3: mod_base = cm
  modified_base 4: mod_base = um
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
ggctgtgaagcatgattcaat

SEQ ID NO: 400 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
gctgtgaagcatgattcaata

SEQ ID NO: 401 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 402 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = cm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gatcgacatacctcagaatca

SEQ ID NO: 403 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 404 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 405 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = gm
  modified_base 5: mod_base = OTHER; note = 2'-O-methyladenosine
  modified_base 6: mod_base = gm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
aacgagctgacatctattcta

SEQ ID NO: 406 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
gtctgttggtctggtttacta

SEQ ID NO: 407 - RNA, 21 nt, synthetic construct
  modified_base 1: mod_base = gm
  modified_base 2: mod_base = um
  modified_base 3: mod_base = gm
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
gtgttgaggagtaccaattga

SEQ ID NO: 408 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = gm
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
cttcagatccctcgatagaga

SEQ ID NO: 409 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = um
  modified_base 5: mod_base = cm
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = gm
  modified_base 17: mod_base = gm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
agatccctcgatagaggaaat

SEQ ID NO: 410 - RNA, 21 nt, synthetic construct
  modified_base 1: mod_base = OTHER; note = 2'-O-methyl-2-aminoadenosine
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = um
  modified_base 8: mod_base = um
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
ngaagtttcgaccaagtatca

SEQ ID NO: 411 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
gaactgctcttcgtattaaga

SEQ ID NO: 412 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = um
  modified_base 13: mod_base = OTHER; note = 2'-fluoroadenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 413 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-O-methyladenosine
  modified_base 12: mod_base = OTHER; note = 2'-fluorouridine
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 414 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = OTHER; note = 2'-fluorouridine
  modified_base 8: mod_base = gm
  modified_base 9: mod_base = um
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 415 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = OTHER; note = 2'-fluorouridine
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 416 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtctgtcatagttccaacaaa

SEQ ID NO: 417 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluoroguanosine
  modified_base 12: mod_base = um
  modified_base 13: mod_base = OTHER; note = 2'-fluorouridine
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 418 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = gm
  modified_base 12: mod_base = OTHER; note = 2'-fluorouridine
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 419 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = OTHER; note = 2'-fluorocytidine
  modified_base 8: mod_base = OTHER; note = 2'-O-methyladenosine
  modified_base 9: mod_base = um
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 420 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = OTHER; note = 2'-fluorocytidine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 421 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = um
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-fluoroadenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 422 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 423 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroadenosine
  modified_base 8: mod_base = um
  modified_base 9: mod_base = cm
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 424 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroadenosine
  modified_base 8: mod_base = um
  modified_base 9: mod_base = OTHER; note = 2'-fluorocytidine
  modified_base 10: mod_base = um
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 425 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-O-methyladenosine
  modified_base 11: mod_base = OTHER; note = 2'-fluoroadenosine
  modified_base 12: mod_base = cm
  modified_base 13: mod_base = OTHER; note = 2'-fluoroadenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 426 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluorocytidine
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 427 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = gm
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 428 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = OTHER; note = 2'-fluoroguanosine
  modified_base 10: mod_base = OTHER; note = 2'-O-methyladenosine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 429 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 430 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
gaaatgcttgatgatacaata

SEQ ID NO: 431 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = gm
  modified_base 11: mod_base = OTHER; note = 2'-fluoroadenosine
  modified_base 12: mod_base = um
  modified_base 13: mod_base = OTHER; note = 2'-fluoroguanosine
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 432 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluorouridine
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 433 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluorocytidine
  modified_base 8: mod_base = um
  modified_base 9: mod_base = um
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 434 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluorocytidine
  modified_base 8: mod_base = um
  modified_base 9: mod_base = OTHER; note = 2'-fluorouridine
  modified_base 10: mod_base = gm
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 435 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = OTHER; note = 2'-fluoroguanosine
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 436 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = um
  modified_base 12: mod_base = OTHER; note = 2'-fluorouridine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 437 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = gm
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 438 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 439 - RNA, 21 nt, synthetic construct
  modified_base 1: mod_base = gm
  modified_base 2: mod_base = um
  modified_base 3: mod_base = cm
  modified_base 4: mod_base = cm
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = um
  modified_base 13: mod_base = OTHER; note = 2'-fluoroadenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcctctgtcatagttccaaa

SEQ ID NO: 440 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = um
  modified_base 13: mod_base = OTHER; note = 2'-fluoroadenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gccttctgtcatagttccaaa

SEQ ID NO: 441 - RNA, 19 nt, synthetic construct
  modified_base 1: mod_base = cm
  modified_base 2: mod_base = cm
  modified_base 3: mod_base = cm
  modified_base 4: mod_base = cm
  modified_base 5: mod_base = um
  modified_base 6: mod_base = gm
  modified_base 7: mod_base = OTHER; note = 2'-fluorouridine
  modified_base 8: mod_base = cm
  modified_base 9: mod_base = OTHER; note = 2'-fluoroadenosine
  modified_base 10: mod_base = um
  modified_base 11: mod_base = OTHER; note = 2'-fluoroadenosine
  modified_base 12: mod_base = gm
  modified_base 13: mod_base = um
  modified_base 14: mod_base = um
  modified_base 15: mod_base = cm
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  source 1..19: mol_type = other RNA
cccctgtcatagttccaaa

SEQ ID NO: 442 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluoroguanosine
  modified_base 12: mod_base = um
  modified_base 13: mod_base = OTHER; note = 2'-fluorouridine
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtctgtcatagttccaacaaa

SEQ ID NO: 443 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 444 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 445 - RNA, 22 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = um
  modified_base 21^22: mod_base = OTHER; note = phosphorothioate linkage
  modified_base 22: mod_base = OTHER; note = 2'-deoxythymidine
  source 1..22: mol_type = other RNA
ggactgaagtgtgtatgtcttt

SEQ ID NO: 446 - RNA, 22 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = gm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
caaacagaaggagcatgttgat

SEQ ID NO: 447 - RNA, 22 nt, synthetic construct
  modified_base 1: mod_base = cm
  modified_base 2: mod_base = OTHER; note = 2'-O-methyladenosine
  modified_base 3: mod_base = gm
  modified_base 4: mod_base = um
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cagtcatgctaaccaatggaat

SEQ ID NO: 448 - RNA, 22 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gtcttctgtcatagttccaaat

SEQ ID NO: 449 - RNA, 22 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  modified_base 21^22: mod_base = OTHER; note = phosphorothioate linkage
  modified_base 22: mod_base = OTHER; note = 2'-deoxythymidine
  source 1..22: mol_type = other RNA
gtctgtcatagttccaacaatt

SEQ ID NO: 450 - RNA, 22 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gctggtatctgaatatcatgat

SEQ ID NO: 451 - RNA, 22 nt, synthetic construct
  modified_base 1: mod_base = um
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = cm
  modified_base 13: mod_base = cm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
tgaacagggctccttatatgat

SEQ ID NO: 452 - RNA, 22 nt, synthetic construct
  modified_base 1: mod_base = um
  modified_base 2: mod_base = gm
  modified_base 3: mod_base = gm
  modified_base 4: mod_base = um
  modified_base 5: mod_base = cm
  modified_base 6: mod_base = um
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = um
  modified_base 21^22: mod_base = OTHER; note = phosphorothioate linkage
  modified_base 22: mod_base = OTHER; note = 2'-deoxythymidine
  source 1..22: mol_type = other RNA
tggtctggcacaccttcatatt

SEQ ID NO: 453 - RNA, 22 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = gm
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gtctggcacaccttcatatgat

SEQ ID NO: 454 - RNA, 22 nt, synthetic construct
  modified_base 1: mod_base = cm
  modified_base 2: mod_base = um
  modified_base 3: mod_base = gm
  modified_base 4: mod_base = gm
  modified_base 5: mod_base = cm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
ctggcacaccttcatatggaat

SEQ ID NO: 455 - RNA, 22 nt, synthetic construct
  modified_base 1: mod_base = OTHER; note = 2'-O-methyladenosine
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = cm
  modified_base 18: mod_base = um
  modified_base 19: mod_base = OTHER; note = 2'-O-methyladenosine
  modified_base 20: mod_base = um
  modified_base 21: mod_base = um
  modified_base 21^22: mod_base = OTHER; note = phosphorothioate linkage
  modified_base 22: mod_base = OTHER; note = 2'-deoxythymidine
  source 1..22: mol_type = other RNA
acacaaggtaaacctgctattt

SEQ ID NO: 456 - RNA, 22 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = cm
  modified_base 21: mod_base = um
  modified_base 21^22: mod_base = OTHER; note = phosphorothioate linkage
  modified_base 22: mod_base = OTHER; note = 2'-deoxythymidine
  source 1..22: mol_type = other RNA
caaggtaaacctgctattgctt

SEQ ID NO: 457 - RNA, 22 nt, synthetic construct
  modified_base 1: mod_base = um
  modified_base 2: mod_base = um
  modified_base 3: mod_base = gm
  modified_base 4: mod_base = um
  modified_base 5: mod_base = gm
  modified_base 6: mod_base = cm
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
ttgtgccatagcggacttagat

SEQ ID NO: 458 - RNA, 22 nt, synthetic construct
  modified_base 1: mod_base = gm
  modified_base 2: mod_base = gm
  modified_base 3: mod_base = cm
  modified_base 4: mod_base = um
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  modified_base 21^22: mod_base = OTHER; note = phosphorothioate linkage
  modified_base 22: mod_base = OTHER; note = 2'-deoxythymidine
  source 1..22: mol_type = other RNA
ggctgtgaagcatgattcaatt

SEQ ID NO: 459 - RNA, 22 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gctgtgaagcatgattcaatat

SEQ ID NO: 460 - RNA, 22 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gcaatactgaacactatcgaat

SEQ ID NO: 461 - RNA, 22 nt, synthetic construct
  modified_base 1: mod_base = gm
  modified_base 2: mod_base = OTHER; note = 2'-O-methyladenosine
  modified_base 3: mod_base = um
  modified_base 4: mod_base = cm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gatcgacatacctcagaatcat

SEQ ID NO: 462 - RNA, 22 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cctgaaatgcttgatgatacat

SEQ ID NO: 463 - RNA, 22 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gnaatgcttgatgatacantat

SEQ ID NO: 464 - RNA, 22 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = gm
  modified_base 5: mod_base = OTHER; note = 2'-O-methyladenosine
  modified_base 6: mod_base = gm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
aacgagctgacatctattctat

SEQ ID NO: 465 - RNA, 22 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gtctgttggtctggtttactat

SEQ ID NO: 466 - RNA, 22 nt, synthetic construct
  modified_base 1: mod_base = gm
  modified_base 2: mod_base = um
  modified_base 3: mod_base = gm
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gtgttgaggagtaccaattgat

SEQ ID NO: 467 - RNA, 22 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = gm
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = gm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cttcagatccctcgatagagat

SEQ ID NO: 468 - RNA, 22 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = um
  modified_base 5: mod_base = cm
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = gm
  modified_base 17: mod_base = gm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = um
  modified_base 21^22: mod_base = OTHER; note = phosphorothioate linkage
  modified_base 22: mod_base = OTHER; note = 2'-deoxythymidine
  source 1..22: mol_type = other RNA
agatccctcgatagaggaaatt

SEQ ID NO: 469 - RNA, 22 nt, synthetic construct
  modified_base 1: mod_base = OTHER; note = 2'-O-methyl-2-aminoadenosine
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = um
  modified_base 8: mod_base = um
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
ngaagtttcgaccaagtatcat

SEQ ID NO: 470 - RNA, 22 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gaactgctcttcgtattaagat

SEQ ID NO: 471 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = um
  source 1..21: mol_type = other RNA
ggactgaagtgtgtatgtctt

SEQ ID NO: 472 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
caaacagaaggagcatgttga

SEQ ID NO: 473 - RNA, 21 nt, synthetic construct
  modified_base 1: mod_base = cm
  modified_base 2: mod_base = OTHER; note = 2'-O-methyladenosine
  modified_base 3: mod_base = gm
  modified_base 4: mod_base = um
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
cagtcatgctaaccaatggaa

SEQ ID NO: 474 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 475 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 476 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 477 - RNA, 21 nt, synthetic construct
  modified_base 1: mod_base = um
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = cm
  modified_base 13: mod_base = cm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
tgaacagggctccttatatga

SEQ ID NO: 478 - RNA, 21 nt, synthetic construct
  modified_base 1: mod_base = um
  modified_base 2: mod_base = gm
  modified_base 3: mod_base = gm
  modified_base 4: mod_base = um
  modified_base 5: mod_base = cm
  modified_base 6: mod_base = um
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = um
  source 1..21: mol_type = other RNA
tggtctggcacaccttcatat

SEQ ID NO: 479 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = gm
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gtctggcacaccttcatatga

SEQ ID NO: 480 - RNA, 21 nt, synthetic construct
  modified_base 1: mod_base = cm
  modified_base 2: mod_base = um
  modified_base 3: mod_base = gm
  modified_base 4: mod_base = gm
  modified_base 5: mod_base = cm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
ctggcacaccttcatatggaa

SEQ ID NO: 481 - RNA, 21 nt, synthetic construct
  modified_base 1: mod_base = OTHER; note = 2'-O-methyladenosine
  modified_base 2: mod_base = cm
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = cm
  modified_base 15: mod_base = um
  modified_base 16: mod_base = gm
  modified_base 17: mod_base = cm
  modified_base 18: mod_base = um
  modified_base 19: mod_base = OTHER; note = 2'-O-methyladenosine
  modified_base 20: mod_base = um
  modified_base 21: mod_base = um
  source 1..21: mol_type = other RNA
acacaaggtaaacctgctatt

SEQ ID NO: 482 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = cm
  modified_base 21: mod_base = um
  source 1..21: mol_type = other RNA
caaggtaaacctgctattgct

SEQ ID NO: 483 - RNA, 21 nt, synthetic construct
  modified_base 1: mod_base = um
  modified_base 2: mod_base = um
  modified_base 3: mod_base = gm
  modified_base 4: mod_base = um
  modified_base 5: mod_base = gm
  modified_base 6: mod_base = cm
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = gm
  modified_base 14: mod_base = gm
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
ttgtgccatagcggacttaga

SEQ ID NO: 484 - RNA, 21 nt, synthetic construct
  modified_base 1: mod_base = gm
  modified_base 2: mod_base = gm
  modified_base 3: mod_base = cm
  modified_base 4: mod_base = um
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
ggctgtgaagcatgattcaat

SEQ ID NO: 485 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
gctgtgaagcatgattcaata

SEQ ID NO: 486 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 487 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = cm
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = cm
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
gatcgacatacctcagaatca

SEQ ID NO: 488 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 489 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 490 - RNA, 21 nt, synthetic construct
  modified_base 1: mod_base = OTHER; note = 2'-O-methyladenosine
  modified_base 2: mod_base = OTHER; note = 2'-O-methyladenosine
  modified_base 3: mod_base = cm
  modified_base 4: mod_base = gm
  modified_base 5: mod_base = OTHER; note = 2'-O-methyladenosine
  modified_base 6: mod_base = gm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
aacgagctgacatctattcta

SEQ ID NO: 491 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine
  source 1..21: mol_type = other RNA
gtctgttggtctggtttacta

SEQ ID NO: 492 - RNA, 21 nt, synthetic construct
  modified_base 1: mod_base = gm
  modified_base 2: mod_base = um
  modified_base 3: mod_base = gm
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = OTHER; note = 2'-O-methyladenosine
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
gtgttgaggagtaccaattga

SEQ ID NO: 493 - RNA, 21 nt, synthetic construct
  modified_base 1: mod_base = cm
  modified_base 2: mod_base = um
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = cm
  modified_base 14: mod_base = gm
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
cttcagatccctcgatagaga

SEQ ID NO: 494 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = um
  modified_base 5: mod_base = cm
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = gm
  modified_base 17: mod_base = gm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
agatccctcgatagaggaaat

SEQ ID NO: 495 - RNA, 21 nt, synthetic construct
  modified_base 1: mod_base = OTHER; note = 2'-O-methyl-2-aminoadenosine
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = um
  modified_base 8: mod_base = um
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = gm
  modified_base 17: mod_base = um
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
ngaagtttcgaccaagtatca

SEQ ID NO: 496 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorouridine
  modified_base 12: mod_base = cm
  modified_base 13: mod_base = gm
  modified_base 14: mod_base = um
  modified_base 15: mod_base = OTHER; note = 2'-O-methyladenosine
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
gaactgctcttcgtattaaga

SEQ ID NO: 497 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = um
  modified_base 13: mod_base = OTHER; note = 2'-fluoroadenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 498 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-O-methyladenosine
  modified_base 12: mod_base = OTHER; note = 2'-fluorouridine
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 499 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = OTHER; note = 2'-fluorouridine
  modified_base 8: mod_base = gm
  modified_base 9: mod_base = um
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 500 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = OTHER; note = 2'-fluorouridine
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 501 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtctgtcatagttccaacaaa

SEQ ID NO: 502 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluoroguanosine
  modified_base 12: mod_base = um
  modified_base 13: mod_base = OTHER; note = 2'-fluorouridine
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 503 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = gm
  modified_base 12: mod_base = OTHER; note = 2'-fluorouridine
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 504 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = OTHER; note = 2'-fluorocytidine
  modified_base 8: mod_base = OTHER; note = 2'-O-methyladenosine
  modified_base 9: mod_base = um
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 505 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = OTHER; note = 2'-fluorocytidine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 506 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = um
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-fluoroadenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 507 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = gm
  modified_base 12: mod_base = OTHER; note = 2'-fluoroadenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 508 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroadenosine
  modified_base 8: mod_base = um
  modified_base 9: mod_base = cm
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 509 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroadenosine
  modified_base 8: mod_base = um
  modified_base 9: mod_base = OTHER; note = 2'-fluorocytidine
  modified_base 10: mod_base = um
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 510 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-O-methyladenosine
  modified_base 11: mod_base = OTHER; note = 2'-fluoroadenosine
  modified_base 12: mod_base = cm
  modified_base 13: mod_base = OTHER; note = 2'-fluoroadenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 511 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluorocytidine
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 512 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = gm
  modified_base 10: mod_base = OTHER; note = 2'-fluoroadenosine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 513 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = OTHER; note = 2'-fluoroguanosine
  modified_base 10: mod_base = OTHER; note = 2'-O-methyladenosine
  modified_base 11: mod_base = OTHER; note = 2'-fluoroadenosine
  modified_base 12: mod_base = cm
  modified_base 13: mod_base = OTHER; note = 2'-O-methyladenosine
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine
  source 1..21: mol_type = other RNA
gcaatactgaacactatcgaa

SEQ ID NO: 514 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 515 - RNA, 22 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gaaatgcttgatgatacaatat

SEQ ID NO: 516 - RNA, 22 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = gm
  modified_base 11: mod_base = OTHER; note = 2'-fluoroadenosine
  modified_base 12: mod_base = um
  modified_base 13: mod_base = OTHER; note = 2'-fluoroguanosine
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gnaatgcttgatgatacantat

SEQ ID NO: 517 - RNA, 22 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluorouridine
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gnaatgcttgatgatacantat

SEQ ID NO: 518 - RNA, 22 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluorocytidine
  modified_base 8: mod_base = um
  modified_base 9: mod_base = um
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gnaatgcttgatgatacantat

SEQ ID NO: 519 - RNA, 22 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluorocytidine
  modified_base 8: mod_base = um
  modified_base 9: mod_base = OTHER; note = 2'-fluorouridine
  modified_base 10: mod_base = gm
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gnaatgcttgatgatacantat

SEQ ID NO: 520 - RNA, 22 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = OTHER; note = 2'-fluoroguanosine
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cctgaaatgcttgatgatacat

SEQ ID NO: 521 - RNA, 22 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = um
  modified_base 12: mod_base = OTHER; note = 2'-fluorouridine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cctgaaatgcttgatgatacat

SEQ ID NO: 522 - RNA, 22 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = gm
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cctgaaatgcttgatgatacat

SEQ ID NO: 523 - RNA, 22 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cctgaaatgcttgatgatacat

SEQ ID NO: 524 - RNA, 21 nt, synthetic construct
  modified_base 1: mod_base = gm
  modified_base 2: mod_base = um
  modified_base 3: mod_base = cm
  modified_base 4: mod_base = cm
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = um
  modified_base 13: mod_base = OTHER; note = 2'-fluoroadenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcctctgtcatagttccaaa

SEQ ID NO: 525 - RNA, 21 nt, synthetic construct
  modified_base 1: mod_base = gm
  modified_base 2: mod_base = cm
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = cm
  modified_base 11: mod_base = OTHER; note = 2'-fluoroadenosine
  modified_base 12: mod_base = um
  modified_base 13: mod_base = OTHER; note = 2'-fluoroadenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gccttctgtcatagttccaaa

SEQ ID NO: 526 - RNA, 19 nt, synthetic construct
  modified_base 1: mod_base = cm
  modified_base 2: mod_base = cm
  modified_base 3: mod_base = cm
  modified_base 4: mod_base = cm
  modified_base 5: mod_base = um
  modified_base 6: mod_base = gm
  modified_base 7: mod_base = OTHER; note = 2'-fluorouridine
  modified_base 8: mod_base = cm
  modified_base 9: mod_base = OTHER; note = 2'-fluoroadenosine
  modified_base 10: mod_base = um
  modified_base 11: mod_base = OTHER; note = 2'-fluoroadenosine
  modified_base 12: mod_base = gm
  modified_base 13: mod_base = um
  modified_base 14: mod_base = um
  modified_base 15: mod_base = cm
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methyladenosine
  source 1..19: mol_type = other RNA
cccctgtcatagttccaaa

SEQ ID NO: 527 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluoroguanosine
  modified_base 12: mod_base = um
  modified_base 13: mod_base = OTHER; note = 2'-fluorouridine
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtctgtcatagttccaacaaa

SEQ ID NO: 528 - RNA, 22 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cctgaaatgcttgatgatacat

SEQ ID NO: 529 - RNA, 22 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cctgaaatgcttgatgatacat

SEQ ID NO: 530 - RNA, 21 nt, synthetic construct
  modified_base 1: mod_base = gm
  modified_base 2: mod_base = um
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = cm
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = cm
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
gtgaagcacgattctatcata

SEQ ID NO: 531 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = OTHER; note = 2'-O-methyladenosine
  modified_base 5: mod_base = cm
  modified_base 6: mod_base = OTHER; note = 2'-O-methyladenosine
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyladenosine
  source 1..21: mol_type = other RNA
gagacataccccagaatccta

SEQ ID NO: 532 - RNA, 21 nt, synthetic construct
  modified_base 1: mod_base = OTHER; note = 2'-O-methyladenosine
  modified_base 2: mod_base = gm
  modified_base 3: mod_base = cm
  modified_base 4: mod_base = gm
  modified_base 5: mod_base = OTHER; note = 2'-O-methyladenosine
  modified_base 6: mod_base = gm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = um
  modified_base 18: mod_base = um
  modified_base 19: mod_base = cm
  modified_base 20: mod_base = gm
  modified_base 21: mod_base = OTHER; note = 2'-O-methyladenosine
  source 1..21: mol_type = other RNA
agcgagctgacatctattcga

SEQ ID NO: 533 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 534 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 535 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  source 1..21: mol_type = other RNA
gtctgtcatagttccaacaat

SEQ ID NO: 536 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = gm
  modified_base 6: mod_base = um
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gctggtatctgaatatcatga

SEQ ID NO: 537 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = OTHER; note = 2'-fluoroguanosine
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 538 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = um
  modified_base 12: mod_base = OTHER; note = 2'-fluorouridine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 539 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = gm
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 540 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 541 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
gaaatgcttgatgatacaata

SEQ ID NO: 542 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = gm
  modified_base 11: mod_base = OTHER; note = 2'-fluoroadenosine
  modified_base 12: mod_base = um
  modified_base 13: mod_base = OTHER; note = 2'-fluoroguanosine
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 543 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluorouridine
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 544 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluorocytidine
  modified_base 8: mod_base = um
  modified_base 9: mod_base = um
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 545 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluorocytidine
  modified_base 8: mod_base = um
  modified_base 9: mod_base = OTHER; note = 2'-fluorouridine
  modified_base 10: mod_base = gm
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  source 1..21: mol_type = other RNA
gnaatgcttgatgatacanta

SEQ ID NO: 546 - RNA, 21 nt, synthetic construct
  modified_base 1: mod_base = gm
  modified_base 2: mod_base = um
  modified_base 3: mod_base = cm
  modified_base 4: mod_base = um
  modified_base 5: mod_base = um
  modified_base 6: mod_base = cm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gtcttctgtcatagttccaaa

SEQ ID NO: 547 - RNA, 22 nt, synthetic construct
  modified_base 1: mod_base = gm
  modified_base 2: mod_base = um
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = um
  modified_base 21^22: mod_base = OTHER; note = phosphorothioate linkage
  modified_base 22: mod_base = OTHER; note = 2'-deoxythymidine
  source 1..22: mol_type = other RNA
gtctgtcatagttccaacaatt

SEQ ID NO: 548 - RNA, 22 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
cctgaaatgcttgatgatacat

SEQ ID NO: 549 - RNA, 21 nt, synthetic construct
  modified_base 1: mod_base = cm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = um
  modified_base 9: mod_base = OTHER; note = 2'-fluoroguanosine
  modified_base 10: mod_base = cm
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
cctgaaatgcttgatgataca

SEQ ID NO: 550 - RNA, 22 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = OTHER; note = 2'-O-methyl-2-aminoadenosine
  modified_base 20: mod_base = um
  modified_base 21: mod_base = OTHER; note = 2'-O-methyladenosine
  modified_base 21^22: mod_base = OTHER; note = phosphorothioate linkage
  modified_base 22: mod_base = OTHER; note = 2'-deoxythymidine
  source 1..22: mol_type = other RNA
gnaatgcttgatgatacantat

SEQ ID NO: 551 - RNA, 21 nt, synthetic construct
  source 1..21: mol_type = other RNA
tatgatagaatcgtgcttcac

SEQ ID NO: 552 - RNA, 21 nt, synthetic construct
  source 1..21: mol_type = other RNA
taggattctggggtatgtctc

SEQ ID NO: 553 - RNA, 21 nt, synthetic construct
  source 1..21: mol_type = other RNA
tcgaatagatgtcagctcgct

SEQ ID NO: 554 - RNA, 21 nt, synthetic construct
  source 1..21: mol_type = other RNA
aagacatacacacttcagtcc

SEQ ID NO: 555 - RNA, 21 nt, synthetic construct
  source 1..21: mol_type = other RNA
tcaacatgctccttctgtttg

SEQ ID NO: 556 - RNA, 21 nt, synthetic construct
  source 1..21: mol_type = other RNA
ttccattggttagcatgactg

SEQ ID NO: 557 - RNA, 21 nt, synthetic construct
  source 1..21: mol_type = other RNA
tttggaactatgacagaagac

SEQ ID NO: 558 - RNA, 21 nt, synthetic construct
  source 1..21: mol_type = other RNA
attgttggaactatgacagac

SEQ ID NO: 559 - RNA, 21 nt, synthetic construct
  source 1..21: mol_type = other RNA
tcatgatattcagataccagc

SEQ ID NO: 560 - RNA, 21 nt, synthetic construct
  source 1..21: mol_type = other RNA
tcatataaggagccctgttca

SEQ ID NO: 561 - RNA, 21 nt, synthetic construct
  source 1..21: mol_type = other RNA
atatgaaggtgtgccagacca

SEQ ID NO: 562 - RNA, 21 nt, synthetic construct
  source 1..21: mol_type = other RNA
tcatatgaaggtgtgccagac

SEQ ID NO: 563 - RNA, 21 nt, synthetic construct
  source 1..21: mol_type = other RNA
ttccatatgaaggtgtgccag

SEQ ID NO: 564 - RNA, 21 nt, synthetic construct
  source 1..21: mol_type = other RNA
aatagcaggtttaccttgtgt

SEQ ID NO: 565 - RNA, 21 nt, synthetic construct
  source 1..21: mol_type = other RNA
agcaatagcaggtttaccttg

SEQ ID NO: 566 - RNA, 21 nt, synthetic construct
  source 1..21: mol_type = other RNA
tctaagtccgctatggcacaa

SEQ ID NO: 567 - RNA, 21 nt, synthetic construct
  source 1..21: mol_type = other RNA
attgaatcatgcttcacagcc

SEQ ID NO: 568 - RNA, 21 nt, synthetic construct
  source 1..21: mol_type = other RNA
tattgaatcatgcttcacagc

SEQ ID NO: 569 - RNA, 21 nt, synthetic construct
  source 1..21: mol_type = other RNA
ttcgatagtgttcagtattgc

SEQ ID NO: 570 - RNA, 21 nt, synthetic construct
  source 1..21: mol_type = other RNA
tgattctgaggtatgtcgatc

SEQ ID NO: 571 - RNA, 21 nt, synthetic construct
  source 1..21: mol_type = other RNA
tgtatcatcaagcatttcagg

SEQ ID NO: 572 - RNA, 21 nt, synthetic construct
  source 1..21: mol_type = other RNA
tattgtatcatcaagcatttc

SEQ ID NO: 573 - RNA, 21 nt, synthetic construct
  source 1..21: mol_type = other RNA
tagaatagatgtcagctcgtt

SEQ ID NO: 574 - RNA, 21 nt, synthetic construct
  source 1..21: mol_type = other RNA
tagtaaaccagaccaacagac

SEQ ID NO: 575 - RNA, 21 nt, synthetic construct
  source 1..21: mol_type = other RNA
tcaattggtactcctcaacac

SEQ ID NO: 576 - RNA, 21 nt, synthetic construct
  source 1..21: mol_type = other RNA
tctctatcgagggatctgaag

SEQ ID NO: 577 - RNA, 21 nt, synthetic construct
  source 1..21: mol_type = other RNA
atttcctctatcgagggatct

SEQ ID NO: 578 - RNA, 21 nt, synthetic construct
  source 1..21: mol_type = other RNA
tgatacttggtcgaaacttct

SEQ ID NO: 579 - RNA, 21 nt, synthetic construct
  source 1..21: mol_type = other RNA
tcttaatacgaagagcagttc

SEQ ID NO: 580 - RNA, 21 nt, synthetic construct
  source 1..21: mol_type = other RNA
tttgttggaactatgacagac

SEQ ID NO: 581 - RNA, 21 nt, synthetic construct
  modified_base 1: mod_base = i
  source 1..21: mol_type = other RNA
nttgttggaactatgacagac

SEQ ID NO: 582 - RNA, 21 nt, synthetic construct
  source 1..21: mol_type = other RNA
tttggaactatgatagaagac

SEQ ID NO: 583 - RNA, 21 nt, synthetic construct
  source 1..21: mol_type = other RNA
tttggaactatgacagaggac

SEQ ID NO: 584 - RNA, 21 nt, synthetic construct
  source 1..21: mol_type = other RNA
tttggaactatgacagaaggc

SEQ ID NO: 585 - RNA, 21 nt, synthetic construct
  source 1..21: mol_type = other RNA
tttggaactatgatagaggac

SEQ ID NO: 586 - RNA, 21 nt, synthetic construct
  source 1..21: mol_type = other RNA
tttggaactatgatagaaggc

SEQ ID NO: 587 - RNA, 19 nt, synthetic construct
  source 1..19: mol_type = other RNA
tttggaactatgacagggg

SEQ ID NO: 588 - RNA, 19 nt, synthetic construct
  source 1..19: mol_type = other RNA
tttggaactatgatagggg

SEQ ID NO: 589 - RNA, 21 nt, synthetic construct
  source 1..21: mol_type = other RNA
tttgggactatgacagaagac

SEQ ID NO: 590 - RNA, 21 nt, synthetic construct
  source 1..21: mol_type = other RNA
tttgggactatgacagaggac

SEQ ID NO: 591 - RNA, 21 nt, synthetic construct
  source 1..21: mol_type = other RNA
tttggagctatgacagaagac

SEQ ID NO: 592 - RNA, 21 nt, synthetic construct
  source 1..21: mol_type = other RNA
tttggagctatgacagaggac

SEQ ID NO: 593 - RNA, 21 nt, synthetic construct
  modified_base 4: mod_base = i
  source 1..21: mol_type = other RNA
tttngaactatgacagaagac

SEQ ID NO: 594 - RNA, 21 nt, synthetic construct
  modified_base 5: mod_base = i
  source 1..21: mol_type = other RNA
tttgnaactatgacagaagac

SEQ ID NO: 595 - RNA, 21 nt, synthetic construct
  source 1..21: mol_type = other RNA
ggactgaagtgtgtatgtctt

SEQ ID NO: 596 - RNA, 21 nt, synthetic construct
  source 1..21: mol_type = other RNA
caaacagaaggagcatgttga

SEQ ID NO: 597 - RNA, 21 nt, synthetic construct
  source 1..21: mol_type = other RNA
cagtcatgctaaccaatggaa

SEQ ID NO: 598 - RNA, 21 nt, synthetic construct
  source 1..21: mol_type = other RNA
gtcttctgtcatagttccaaa

SEQ ID NO: 599 - RNA, 21 nt, synthetic construct
  source 1..21: mol_type = other RNA
gtctgtcatagttccaacaat

SEQ ID NO: 600 - RNA, 21 nt, synthetic construct
  source 1..21: mol_type = other RNA
gctggtatctgaatatcatga

SEQ ID NO: 601 - RNA, 21 nt, synthetic construct
  source 1..21: mol_type = other RNA
tgaacagggctccttatatga

SEQ ID NO: 602 - RNA, 21 nt, synthetic construct
  source 1..21: mol_type = other RNA
tggtctggcacaccttcatat

SEQ ID NO: 603 - RNA, 21 nt, synthetic construct
  source 1..21: mol_type = other RNA
gtctggcacaccttcatatga

SEQ ID NO: 604 - RNA, 21 nt, synthetic construct
  source 1..21: mol_type = other RNA
ctggcacaccttcatatggaa

SEQ ID NO: 605 - RNA, 21 nt, synthetic construct
  source 1..21: mol_type = other RNA
acacaaggtaaacctgctatt

SEQ ID NO: 606 - RNA, 21 nt, synthetic construct
  source 1..21: mol_type = other RNA
caaggtaaacctgctattgct

SEQ ID NO: 607 - RNA, 21 nt, synthetic construct
  source 1..21: mol_type = other RNA
ttgtgccatagcggacttaga

SEQ ID NO: 608 - RNA, 21 nt, synthetic construct
  source 1..21: mol_type = other RNA
ggctgtgaagcatgattcaat

SEQ ID NO: 609 - RNA, 21 nt, synthetic construct
  source 1..21: mol_type = other RNA
gctgtgaagcatgattcaata

SEQ ID NO: 610 - RNA, 21 nt, synthetic construct
  source 1..21: mol_type = other RNA
gcaatactgaacactatcgaa

SEQ ID NO: 611 - RNA, 21 nt, synthetic construct
  source 1..21: mol_type = other RNA
gatcgacatacctcagaatca

SEQ ID NO: 612 - RNA, 21 nt, synthetic construct
  source 1..21: mol_type = other RNA
cctgaaatgcttgatgataca

SEQ ID NO: 613 - RNA, 21 nt, synthetic construct
  modified_base 2: mod_base = OTHER; note = 2-aminoadenosine nucleotide
  modified_base 19: mod_base = OTHER; note = 2-aminoadenosine nucleotide
  source 1..21: mol_type = other RNA
gnaatgcttgatgatacanta

SEQ ID NO: 614 - RNA, 21 nt, synthetic construct
  source 1..21: mol_type = other RNA
aacgagctgacatctattcta

SEQ ID NO: 615 - RNA, 21 nt, synthetic construct
  source 1..21: mol_type = other RNA
gtctgttggtctggtttacta

SEQ ID NO: 616 - RNA, 21 nt, synthetic construct
  source 1..21: mol_type = other RNA
gtgttgaggagtaccaattga

SEQ ID NO: 617 - RNA, 21 nt, synthetic construct
  source 1..21: mol_type = other RNA
cttcagatccctcgatagaga

SEQ ID NO: 618 - RNA, 21 nt, synthetic construct
  source 1..21: mol_type = other RNA
agatccctcgatagaggaaat

SEQ ID NO: 619 - RNA, 21 nt, synthetic construct
  modified_base 1: mod_base = OTHER; note = 2-aminoadenosine nucleotide
  source 1..21: mol_type = other RNA
ngaagtttcgaccaagtatca

SEQ ID NO: 620 - RNA, 21 nt, synthetic construct
  source 1..21: mol_type = other RNA
gaactgctcttcgtattaaga

SEQ ID NO: 621 - RNA, 21 nt, synthetic construct
  source 1..21: mol_type = other RNA
gtctgtcatagttccaacaaa

SEQ ID NO: 622 - RNA, 21 nt, synthetic construct
  source 1..21: mol_type = other RNA
gaaatgcttgatgatacaata

SEQ ID NO: 623 - RNA, 21 nt, synthetic construct
  source 1..21: mol_type = other RNA
gtcctctgtcatagttccaaa

SEQ ID NO: 624 - RNA, 21 nt, synthetic construct
  source 1..21: mol_type = other RNA
gccttctgtcatagttccaaa

SEQ ID NO: 625 - RNA, 19 nt, synthetic construct
  source 1..19: mol_type = other RNA
cccctgtcatagttccaaa

SEQ ID NO: 626 - RNA, 22 nt, synthetic construct
  source 1..22: mol_type = other RNA
ggactgaagtgtgtatgtcttt

SEQ ID NO: 627 - RNA, 22 nt, synthetic construct
  source 1..22: mol_type = other RNA
caaacagaaggagcatgttgat

SEQ ID NO: 628 - RNA, 22 nt, synthetic construct
  source 1..22: mol_type = other RNA
cagtcatgctaaccaatggaat

SEQ ID NO: 629 - RNA, 22 nt, synthetic construct
  source 1..22: mol_type = other RNA
gtcttctgtcatagttccaaat

SEQ ID NO: 630 - RNA, 22 nt, synthetic construct
  source 1..22: mol_type = other RNA
gtctgtcatagttccaacaatt

SEQ ID NO: 631 - RNA, 22 nt, synthetic construct
  source 1..22: mol_type = other RNA
gctggtatctgaatatcatgat

SEQ ID NO: 632 - RNA, 22 nt, synthetic construct
  source 1..22: mol_type = other RNA
tgaacagggctccttatatgat

SEQ ID NO: 633 - RNA, 22 nt, synthetic construct
  source 1..22: mol_type = other RNA
tggtctggcacaccttcatatt

SEQ ID NO: 634 - RNA, 22 nt, synthetic construct
  source 1..22: mol_type = other RNA
gtctggcacaccttcatatgat

SEQ ID NO: 635 - RNA, 22 nt, synthetic construct
  source 1..22: mol_type = other RNA
ctggcacaccttcatatggaat

SEQ ID NO: 636 - RNA, 22 nt, synthetic construct
  source 1..22: mol_type = other RNA
acacaaggtaaacctgctattt

SEQ ID NO: 637 - RNA, 22 nt, synthetic construct
  source 1..22: mol_type = other RNA
caaggtaaacctgctattgctt

SEQ ID NO: 638 - RNA, 22 nt, synthetic construct
  source 1..22: mol_type = other RNA
ttgtgccatagcggacttagat

SEQ ID NO: 639 - RNA, 22 nt, synthetic construct
  source 1..22: mol_type = other RNA
ggctgtgaagcatgattcaatt

SEQ ID NO: 640 - RNA, 22 nt, synthetic construct
  source 1..22: mol_type = other RNA
gctgtgaagcatgattcaatat

SEQ ID NO: 641 - RNA, 22 nt, synthetic construct
  source 1..22: mol_type = other RNA
gcaatactgaacactatcgaat

SEQ ID NO: 642 - RNA, 22 nt, synthetic construct
  source 1..22: mol_type = other RNA
gatcgacatacctcagaatcat

SEQ ID NO: 643 - RNA, 22 nt, synthetic construct
  source 1..22: mol_type = other RNA
cctgaaatgcttgatgatacat

SEQ ID NO: 644 - RNA, 22 nt, synthetic construct
  modified_base 2: mod_base = OTHER; note = 2-aminoadenosine nucleotide
  modified_base 19: mod_base = OTHER; note = 2-aminoadenosine nucleotide
  source 1..22: mol_type = other RNA
gnaatgcttgatgatacantat

SEQ ID NO: 645 - RNA, 22 nt, synthetic construct
  source 1..22: mol_type = other RNA
aacgagctgacatctattctat

SEQ ID NO: 646 - RNA, 22 nt, synthetic construct
  source 1..22: mol_type = other RNA
gtctgttggtctggtttactat

SEQ ID NO: 647 - RNA, 22 nt, synthetic construct
  source 1..22: mol_type = other RNA
gtgttgaggagtaccaattgat

SEQ ID NO: 648 - RNA, 22 nt, synthetic construct
  source 1..22: mol_type = other RNA
cttcagatccctcgatagagat

SEQ ID NO: 649 - RNA, 22 nt, synthetic construct
  source 1..22: mol_type = other RNA
agatccctcgatagaggaaatt

SEQ ID NO: 650 - RNA, 22 nt, synthetic construct
  modified_base 1: mod_base = OTHER; note = 2-aminoadenosine nucleotide
  source 1..22: mol_type = other RNA
ngaagtttcgaccaagtatcat

SEQ ID NO: 651 - RNA, 22 nt, synthetic construct
  source 1..22: mol_type = other RNA
gaactgctcttcgtattaagat

SEQ ID NO: 652 - RNA, 22 nt, synthetic construct
  source 1..22: mol_type = other RNA
gaaatgcttgatgatacaatat

SEQ ID NO: 653 - RNA, 21 nt, synthetic construct
  source 1..21: mol_type = other RNA
gtgaagcacgattctatcata

SEQ ID NO: 654 - RNA, 21 nt, synthetic construct
  source 1..21: mol_type = other RNA
gagacataccccagaatccta

SEQ ID NO: 655 - RNA, 21 nt, synthetic construct
  source 1..21: mol_type = other RNA
agcgagctgacatctattcga

The invention claimed is:

1. An RNAi agent for inhibiting expression of a Activin Receptor-Like Kinase 7 (ALK7) gene, comprising:

an antisense strand wherein nucleotides 1-21 of the antisense strand (5'→3') comprise the nucleotide sequence (5'→3'): AUUGUUGGAACUAUGACAGAC (SEQ ID NO: 558); and a sense strand that comprises a nucleotide sequence that differs by 0 or 1 nucleotides from the nucleotide sequence (5'→3'): GUCUGUCAUAGUUCCAACAAU (SEQ ID NO: 599);

wherein all of the nucleotides of the antisense strand and all of the nucleotides of the sense strand are modified nucleotides, wherein the modified nucleotides are selected from the group consisting of 2'-fluoro modified nucleotides, 2'-O-methyl modified nucleotides, and cyclopropyl phosphonate-containing nucleotides, wherein the sense strand is linked to one or more lipid moieties, and wherein each of the one or more lipid moieties is independently selected from the group consisting of:

LP-371-a

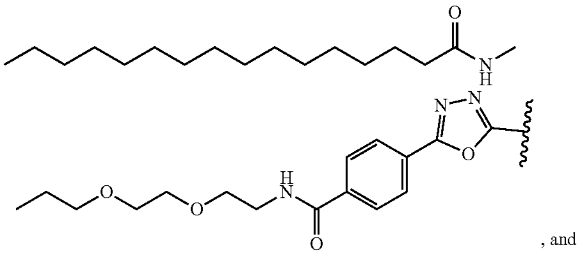

, and

LP-379-a

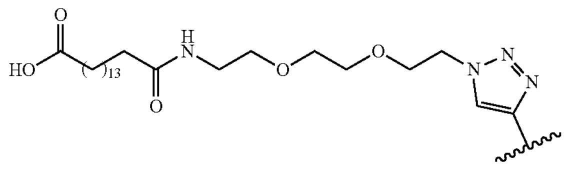

wherein  indicates the point of connection to the RNAi agent.

2. The RNAi agent of claim 1, wherein the one or more lipid moieties are conjugated to the sense strand on the 5' terminus of the sense strand, the 3' terminus of the sense strand, or both the 5' and 3' terminus of the sense strand.

3. The RNAi agent of claim 1, wherein the sense strand and the antisense strand are each between 21 and 24 nucleotides in length.

4. The RNAi agent of claim 1, wherein the sense strand and the antisense strand are each 21 nucleotides in length.

5. The RNAi agent of claim 1, wherein the sense strand comprises one or two inverted abasic residues.

6. The RNAi agent of claim 1, wherein the antisense strand comprises the modified nucleotide sequence (5'→3'): cPrpasUfsuguuGfgaacUfaUfgAfcagasc (SEQ ID NO: 269);

wherein a represents 2'-O-methyl adenosine, c represents 2'-O-methyl cytidine, g represents 2'-O-methyl guanosine, and u represent 2'-O-methyl uridine; Af represents 2'-fluoro adenosine, Cf represents 2'-fluoro cytidine, Gf represents 2'-fluoro guanosine, and Uf represents 2'-fluoro uridine; cPrpa represents a 5'-cyclopropyl phosphonate-2'-O-methyl adenosine; s represents a phosphorothioate linkage; and wherein all of the nucleotides on the sense strand are modified nucleotides.

7. The RNAi agent of claim 6, wherein the sense strand comprises the modified nucleotide sequence (5'→3'): gucugucaUfAfGfuuccaacaau (SEQ ID NO: 364)

wherein a represents 2'-O-methyl adenosine, c represents 2'-O-methyl cytidine, g represents 2'-O-methyl guanosine, and u represent 2'-O-methyl uridine; Af represents 2'-fluoro adenosine, Cf represents 2'-fluoro cytidine, Gf represents 2'-fluoro guanosine, and Uf represents 2'-fluoro uridine.

8. The RNAi agent of claim 7, wherein the sense strand further comprises one or more inverted abasic residues.

9. The RNAi agent of claim 8, wherein the RNAi agent is linked to LP-379-a on the 5' terminus of the sense strand, and linked to LP-371-a on the 3' terminus of the sense strand.

10. The RNAi agent of claim 8, wherein the sense strand has the structure: LP-379-a-L6-(NH—C6)s(invAb)sgucugucaUfAfGfuuccaacaaus(invAb)-(C6-S)-LP-371-a (SEQ ID NO: 535), and the antisense strand has the structure: cPrpasUfsuguuGfgaacUfaUfgAfcagasc (SEQ ID NO: 269), wherein a represents 2'-O-methyl adenosine, c represents 2'-O-methyl cytidine, g represents 2'-O-methyl guanosine, and u represent 2'-O-methyl uridine; Af represents 2'-fluoro adenosine, Cf represents 2'-fluoro cytidine, Gf represents 2'-fluoro guanosine, and Uf represents 2'-fluoro uridine, cPrpa represents a 5'-cyclopropyl phosphonate-2'-O-methyl adenosine, (invAb) represents an inverted abasic residue, (C6-S) has the structure:

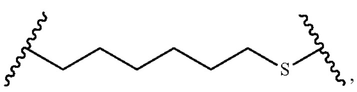 [SMILES: *CCCCCCS*]

,

L6 has the structure:

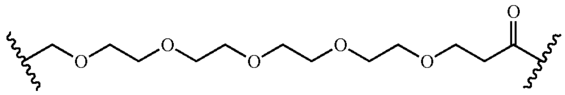

, (NH—C6)s has the structure:

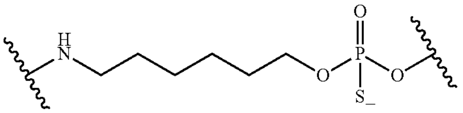

,

LP-379-a has the structure:

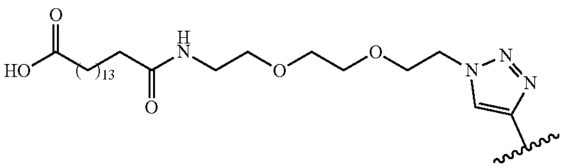

, and LP-371-a has the structure:

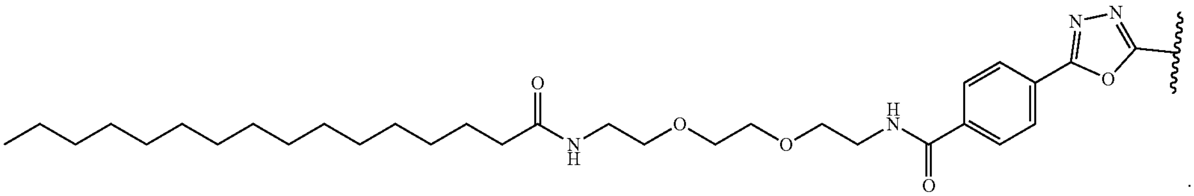 [SMILES: *c1nnc(-c2ccc(C(=O)NCCOCCOCCNC(=O)CCCCCCCCCCCCCCC)cc2)o1]

.

11. The RNAi agent of claim 1, wherein the RNAi agent is a pharmaceutically acceptable salt.

12. The RNAi agent of claim 11, wherein the pharmaceutically acceptable salt is a sodium salt.

13. The RNAi agent of claim 10, wherein the RNAi agent is a sodium salt.

14. A pharmaceutical composition comprising the RNAi agent of claim 1, wherein the composition comprises a pharmaceutically acceptable excipient.

15. A pharmaceutical composition comprising the RNAi agent of claim 10, wherein the composition comprises a pharmaceutically acceptable excipient.

16. The pharmaceutical composition of claim 15, wherein the pharmaceutically acceptable excipient is sodium chloride.

17. A method of treating an ALK7-related disease, disorder, or symptom, the method comprising administering to a human subject in need thereof a therapeutically effective amount of the pharmaceutical composition of claim 16.

18. The method of claim 17, wherein the ALK7-related disease is obesity, diabetes, or insulin resistance.

19. The method of claim 18, wherein the RNAi agent is administered to a human subject at a dose of about 0.01 mg/kg to about 5.0 mg/kg of body weight of the subject.

* * * * *